US006833446B1

(12) United States Patent
Wood et al.

(10) Patent No.: US 6,833,446 B1
(45) Date of Patent: Dec. 21, 2004

(54) COMPOSITIONS AND METHODS FOR THE MODIFICATION OF GENE TRANSCRIPTION

(75) Inventors: Marion Wood, Auckland (NZ); Michael A. Shenk, Auckland (NZ); Annette McGrath, Auckland (NZ); Matthew Glenn, Parnell (NZ)

(73) Assignees: Agrigenesis Biosciences Limited, Auckland (NZ); Rubicon Forest Holdings Limited, Auckland (NZ)

( * ) Notice: Subject to any disclaimer, the term of this patent is extended or adjusted under 35 U.S.C. 154(b) by 142 days.

(21) Appl. No.: 09/640,211

(22) Filed: Aug. 16, 2000

Related U.S. Application Data

(63) Continuation of application No. PCT/US00/06112, filed on Mar. 9, 2000, and a continuation-in-part of application No. 09/266,513, filed on Mar. 11, 1999, now abandoned.
(60) Provisional application No. 60/149,485, filed on Aug. 18, 1999.

(51) Int. Cl.$^7$ .................. C07H 21/00; C07H 21/04; C12N 1/20; C12N 5/00

(52) U.S. Cl. .................. 536/22.1; 536/23.1; 435/252.3; 435/325

(58) Field of Search .................. 536/23.1, 22.1; 435/252.3, 325

(56) References Cited

U.S. PATENT DOCUMENTS

| 4,683,202 A | * | 7/1987 | Mullis .................. 435/91.2 |
| 5,907,082 A | | 5/1999 | O'Neill et al. .................. 800/205 |

FOREIGN PATENT DOCUMENTS

| AU | 3901395 | 11/1995 | ........... C12N/15/29 |
| WO | 9314211 | 7/1993 | ........... C12N/15/82 |
| WO | 9635784 | 11/1996 | ........... C12N/15/12 |
| WO | 9813503 | 4/1998 | ........... C12N/15/82 |
| WO | 9822592 | 5/1998 | ........... C12N/15/29 |
| WO | 9854328 | 12/1998 | ........... C12N/15/29 |

OTHER PUBLICATIONS

Uimari et al., "Myb26: a MYB–like protein of pea flowers with affinity for promoters of pheylpropaniod genes", The Plant Journal, vol. 12, No. 6, pp. 1273–1284 (1997).*
Uimari et al., Accession No. Y11105, Plant Physiol., 117, 720 (1998).*
Jackson, David, et al., "Expression Patterns of myb Genes from Antirrhinum Flowers," The Plant Cell, Feb. 1991, pp. 115–125, vol. 3.
PCT International Search Report; In re Genesis Research and Development Corporation, Ltd.; International Application No. PCT/US00/06112, filed Mar. 9, 2000.
GenBank Accession No. AF029975, submitted Nov. 19, 1998.
GenBank Accession No. T42925, submitted Nov. 6, 1997.
GenBank Accession No. AF1581543, submitted Dec. 16, 1999.
GenBank Accession No. AW394752, submitted Jul. 17, 2000.
GenBank Accession No. AW010840, submitted Sep. 10, 1999.
GenBank Accession No. AF120097, submitted Feb. 1, 2000.
GenBank Accession No. U90348, submitted Oct. 10, 1997.
GenBank Accession No. AW587800, submitted Mar. 22, 2000.
GenBank Accession No. AI812413, submitted Jul. 8, 1999.
GenBank Accession No. AW226013, submitted Dec. 10, 1999.
GenBank Accession No. U90091, submitted Jan. 5, 1999.
GenBank Accession No. U90092, submitted Jan. 5, 1999.
GenBank Accession No. X69899, submitted Nov. 24, 1993.
GenBank Accession No. AW399147, submitted Feb. 7, 2000.
GenBank Accession No. AA867891, submitted Aug. 28, 1998.
GenBank Accession No. AF086642, submitted Apr. 8, 1999.
Zhang, Bei et al, "Isolation and characterization of two related Arabidopsis ocs–element bZIP binding proteins", Plant Journal, vol. 4, No. 4, pp. 711–716 (1993).
Tandre, Karolina et al., "Conifer homologues to genes that control floral development in angiosperms", Plant Molecular Biology, vol. 27, pp. 69–78 (1995).
Sundstrom, Jens et al., "MADS–Box Genes Active in Developing Pollen Cones of Norway Spruce (picea abics) Are Homologous to the B–Class Floral Homeolic Genes in Angiosperms", Developmental Genetics, vol. 25, pp. 253–266 (1999).
Perrey, Ralph et al., "Molecular cloning of a luOpin–specific gene from a cDNA library of suspension–cultured cells of Lupinus polyphyllus ", Plant Molecular Biology, vol. 15, pp. 175–176 (1990).
Newman, Tom et al., "Genes Galore; A summary of Methods for Accessing Results from Large–Scale Partial Sequencing of Anonymous Arabidopsis cDNA Clones", Plant Physiol., vol. 106, pp. 1241–1255 (1994).
Ma, Hongchang et al., "Identification of a homeobox–containing gene with enhanced expression during soybean (Glycine max L.) somatic embryo development", Plant Molecular Biology, vol. 24, pp. 465–473 (1994).
Kawahara, Ryoichi et al., "Isolation and characterization of homeobox–containing genes of carrot", Plant Molecular Biology, vol. 27, pp. 155–164 (1995).

(List continued on next page.)

Primary Examiner—Ethan Whisenant
Assistant Examiner—Joyce Tung
(74) Attorney, Agent, or Firm—Ann W. Speckman; Janet Sleath

(57) ABSTRACT

Novel isolated polynucleotides that encode plant transcription factors are provided, together with DNA constructs comprising such polynucleotides. Methods for using such constructs in modulating the expression of endogenous and/or heterologous genes are also disclosed, together with transgenic plants comprising such constructs.

14 Claims, No Drawings

OTHER PUBLICATIONS

Southerton, Simon G. et al., "Eucalypt MADS–Box Genes Expressed in Developing Flowers", *Plant Physiol.*, vol. 118, pp. 365–372 (1998).

Schena, Mark and Davis, Ronald W., "HD–Zip proteins: Members of an Arabidopsis homeodomain protein superfamily", *Proc. Natl. Acad. Sci.*U.S.A., vol. 89, pp. 3894–3898 (May, 1992).

Bradley, Desmond et al., "Complementary Floral Homeotic Phenotypes Result from Opposite Orientations of a Transposon at the plean Locus of Antirrhinum", *Cell*, vol. 72, pp. 85–95 (Jan. 1993).

Valle, Estela M., et al., "Isolation and expression pattern of huhr 1, a homeobox–containing cDNA from *Helianthus annuus*", *Gene*, vol. 196, pp. 61–68 (1997).

* cited by examiner

US 6,833,446 B1

COMPOSITIONS AND METHODS FOR THE MODIFICATION OF GENE TRANSCRIPTION

CROSS-REFERENCE TO RELATED APPLICATIONS

This application is a continuation and claims priority to International Patent Application No. PCT/US/00/06112, filed Mar. 9, 2000, and U.S. Provisional Patent Application No. 60/149,485, filed Aug. 18, 1999, and is a continuation-in-part of U.S. patent application Ser. No. 09/266,513, filed Mar. 11, 1999 now abandoned.

TECHNICAL FIELD OF THE INVENTION

This invention relates to compositions isolated from plants and their use in the modification of gene transcription and/or expression. More specifically, this invention relates to plant polynucleotide sequences encoding transcription factors that are components of the cellular transcription apparatus and the use of such polynucleotide sequences in the modification of gene expression.

BACKGROUND OF THE INVENTION

Eucaryotic gene expression is regulated, in part, by the cellular processes involved in transcription. During transcription, a single-stranded RNA complementary to the DNA sequence to be transcribed is formed by the action of RNA polymerases. Initiation of transcription in eucaryotic cells is regulated by complex interactions between cis-acting DNA motifs, located upstream of the gene to be transcribed, and trans-acting protein factors. Among the cis-acting regulatory regions are sequences of DNA, termed promoters, which are located close to the transcription initiation site and to which RNA polymerase is first bound, either directly or indirectly. Promoters usually consist of proximal (e.g., TATA box) and more distant elements (e.g., CCAAT box). Enhancers are cis-acting DNA motifs which may be situated further up- and/or down-stream from the initiation site.

Both promoters and enhancers are generally composed of several discrete, often redundant, elements each of which may be recognized by one or more trans-acting regulatory proteins, known as transcription factors. Regulation of the complex patterns of gene expression observed both spatially and temporally, in all developing organisms, is thought to arise from the interaction of enhancer- and promoter-bound, general and tissue-specific transcription factors with DNA (Izawa T, Foster R and Chua N H, *J. Mol. Biol.* 230:1131–1144, 1993; Menkens A E, Schindler U and Cashmore A R, *Trends in Biochem. Sci.* 13:506–510, 1995). Developmental decisions in organisms as diverse as *Drosophila melanogaster, Saccharomyces cerevisiae, Arabidopsis thaliana* and *Pinus radiata* are regulated by transcription factors. These DNA-binding regulatory molecules have been shown to control the expression of genes responsible for the differentiation of different cell types, for example, the differentiation of leaf trichomes and xylem tissue in *Arabidopsis thaliana,* formation of endoderm from embryonic cells in *Xenopus laevis* and the initiation of gene expression in response to environmental and phytohormonal stress in plants (Yanagisawa S and Sheen J, *The Plant Cell* 10:75–89, 1998).

Transcription factors generally bind DNA in a sequence-specific manner and either activate or repress transcription initiation. The specific mechanisms of these interactions remain to be fully elucidated. At least three separate domains have been identified within transcription factors. One is essential for sequence-specific DNA recognition, one for the activation/repression of transcriptional initiation, and one for the formation of protein-protein interactions (such as dimerization). Four motifs, or domains, involved in DNA sequence recognition and/or transcription factor dimerization have been identified to date: zinc fingers; helix-turn-helix; leucine zipper; and helix-loop-helix. Both helix-loop-helix and leucine zipper protein motifs have been implicated in the binding of transcription factors to DNA via their ability to readily form homo- or hetero-dimers in vivo. "Activating" domains are rich in either proline, glutamine or acidic amino acids. It has been proposed that this net negative region of the transcription factor interacts with the TATA box-binding transcription factor TFIID, RNA polymerase, and/or another protein associated with the transcription apparatus.

Studies indicate that many plant transcription factors can be grouped into distinct classes based on their conserved DNA binding domains (Katagiri F and Chua N H, *Trends Genet.* 8:22–27, 1992; Menkens A E, Schindler U and Cashmore A R, *Trends in Biochem. Sci.* 13:506–510, 1995; Martin C and Paz-Ares J, *Trends Genet.* 13:67–73, 1997). Each member of these families interacts and binds with distinct DNA sequence motifs that are often found in multiple gene promoters controlled by different regulatory signals. Several classes of transcription factors that have been identified to date are described below.

The basic/leucine zipper (bZIP) is a conserved family of transcription factors defined by a basic/leucine zipper (bZIP) motif (Landschultz et al., *Science* 240:1759–1764, 1988; McKnight, *Sci Am.* 264:54–64,1991; Foster et al., *FASEB J.* 8[2]:192–200, 1994). Transcriptional regulation of gene expression is mediated by both the bZIPs and other families of transcription factors, through the concerted action of sequence-specific transcription factors that interact with regulatory elements residing in the promoter regions of the corresponding gene. The bZIP bipartite DNA binding structure consists of a region enriched in basic amino acids (basic region) adjacent to a leucine zipper that is characterized by several leucine residues regularly spaced at seven amino acid intervals (Vinson et al., *Science* 246:911–916, 1989). Whereas the basic region directly contacts the DNA, the leucine zipper mediates homodimerisation and heterodimerisation of protein monomers through a parallel interaction of the hydrophobic dimerization interfaces of two α-helices, resulting in a coiled-coil structure (O'Shea et al., *Science* 243:538–542, 1989; *Science* 254:539–544, 1991; Hu et al., *Science* 250:1400–1403,1990; Rasmussen et al., *Proc. Natl. Acad. Sci. USA* 88:561–564, 1991).

Dof proteins are a relatively new class of transcription factor and are thought to mediate the regulation of some patterns of plant gene expression in part by combinatorial interactions between bZIP proteins and other types of transcription factors binding to closely linked sites. Such an example of this combinatorial interaction has been observed between bZIP and Dof transcription factors (Singh, *Plant Physiol.* 118:1111–1120, 1998). These Dof proteins possess a single zinc-finger DNA binding domain that is highly conserved in plants (Yanagisawa, *Trends Plant Sci.* 1:213, 1996). Specific binding of the Dof protein to bZIP transcription factors has been demonstrated and it has been proposed that this specific interaction results in the stimulation of bZIP binding to DNA target sequences in plant promoters (Chen et al., *Plant J.* 10:955–966, 1996). Examples of such Dof/bZIP interactions have been reported in the literature, including for example, the *Arabidopsis thaliana* glutathionine S-transferase-6 gene (GST6) promoter which has been shown to contain several Dof-binding sites closely linked to the ocs element, a recognized bZIP binding site (Singh, Plant Physiol. 118:1111–1120, 1998).

The bZIP family f G-box binding factors from Arabidopsis (including GBF1, GBF2 and GBF3, for example) interact with the palindromic G-box motif (CCACGTGG). However, it has been demonstrated that the DNA binding specificity of such transcription factors, for example GBF1, may be influenced by the nature of the nucleotides flanking the ACGT core (Schindler et al., *EMBO J.* 11:1274–1289, 1992a). In vivo transient and transgenic plant expression studies have shown that these ACGT elements are necessary for maximal transcriptional activation and have been identified in a multitude of plant genes regulated by diverse environmental, physiological, and environmental cues. Classification of these transcription factors based upon their ability to bind to the ACGT core motif yielded a relatively diverse group of proteins, including, for example the CamV 35S promoter as-1-binding protein which exhibits DNA binding site requirements distinct from those proteins interacting with the G-box (Tabata et al., *EMBO J.* 10:1459–1467, 1991). Thus, in addition to defining the individual classes of bZIP proteins on the basis of their DNA binding specificity, such proteins can also be classified according to their heterodimerisation characteristics (Cao et al., *Genes Dev.* 5:1538–1552, 1991; Schindler et al., *EMBO J.* 11:1261–1273, 1992b).

Environmentally inducible promoters require the presence of two cis-acting elements, critical for promoter activity, one of which is the moderately conserved G-box (CCACGTGG) (deVetten et al., *Plant Cell* 4[10]:1295–1307, 1992). A mutation in one of the two elements abolishes or severely reduces the ability of the promoter to respond to environmental changes. The sequence of the second cis-acting element, positioned near the G-box, is not conserved among different environmentally-inducible promoters, but may be similar among promoters induced by the same signal. The spacing between the G-box and the second cis-acting element appears to be critical, suggesting a direct interaction between the respective binding factors (deVetten and Ferl, *Int. J. Biochem.* 26[9]:1055–1068, 1994; Ramachandran et al., *Curr. Opin. Genet. Dev.* 4[5]:642–646, 1994).

Basic helix-loop-helix zipper proteins represent an additional class of bZIP transcription factors described in the literature and includes, for example, the Myc proteins. These proteins contain two regions characteristic of transcription factors: an N-terminal transactivation domain consisting of several phosphorylation sites, and a C-terminal basic helix-loop-helix (bHLH) leucine zipper motif known to mediate dimerization and sequence specific DNA binding via three distinct domains: the leucine zipper, helix-loop-helix, and basic regions.

The Myb family of transcription factors is a group of functionally diverse transcriptional activators found in both plants and animals that is characterized by a conserved amino-terminal DNA-binding domain containing either two (in plant species) or three (in animal species) imperfect tandem repeats of approximately 50 amino acids (Rosinski and Atchley, *J. Mol. Evol.* 46(1):74–83, 1998; Stober-Grasser et al., *Oncogene* 7[3]:589–596, 1992). Comparisons between the amino acid sequences of representative plant and mammalian MYB proteins indicate that there is a greater conservation between the same repeat from different proteins, than between the R2 and R3 repeats from the same protein (Martin and Paz-Ares, *Trends Genet.* 13[2]:67–73, 1997). More than 100 MYB genes have been reported from *Arabidopsis thaliana* (Romero et al., *Plant J.* 14[3]:273–284, 1998), representing the largest regulatory gene family currently known in plants. DNA-binding studies have demonstrated that there are differences, but also frequent overlaps, in binding specificity among plant MYB proteins, in line with the distinct but often related functions that are beginning to be recognized for these proteins. Studies involving the eight putative base-contacting residues in MYB DNA binding domains have revealed that at least six are fully conserved in all plant MYB proteins identified to date and the remaining two are conserved in at least 80% of these proteins (Martin and Paz-Ares, *Trends Genet.* 13[2]:67–73, 1997). Mutational analysis involving residues that do not contact bases have indicated that the sequence-specific binding capacity of MYBs is affected and this may account for some of the differences in the DNA-binding specificity between plant MYB proteins (Solano et al., *J. Biol. Chem.* 272[5]:2889–2895, 1997). This large-sized gene family may contribute to the regulatory flexibility underlying the developmental and metabolic plasticity displayed by plants.

Homeotic transcription factors have, in animals, been implicated in a number of developmental processes including, for example, the control of pattern formation in insects and vertebrate embryos and the specification of cell differentiation in many tissues (Ingham, *Nature* 335:25–34, 1988; McGinnis and Krumlauf, *Cell* 68:283–302, 1992). Homeodomain secondary structures are characterized by a distinctive helix-turn-helix motif initially identified in bacterial DNA binding domains. This helix-turn-helix sequence/structure motif spans approximately 20 amino acids and is characterized by two short helices separated by a sharp 90 degree bend or turn (Harrison and Aggarwal, *Ann. Rev. Biochem.* 59:933–969, 1990). This helix has been shown to bind in the major groove of the DNA helix.

Plant homeobox genes have been identified in a number of plant species including *Arabidopsis thaliana*, maize, parsley and soybean. Expression pattern analysis of maize homeobox gene family members suggests that these transcription factors may be involved in defining specific regions in the vegetative apical meristem, potentially involved in the initiation of leaf structures (Jackson et al., *Development* 120:405–413, 1994). Such observations imply that the plant homeobox genes, as for the animal homeobox genes, may be involved in the determination of cell fate.

Homeodomain-zipper (HD-zip) represents an additional family of homeodomain proteins. These homeodomain-zipper proteins (HD-zip) possess both the characteristic homeodomain linked to an additional leucine zipper dimerization motif. This family includes, for example, Athb-1 and Athb-2 (Sessa et al., *EMBO J.* 12:3507–3517, 1993) and Athb-4 (Carabelli et al., *Plant J.* 4:469–479, 1993).

The LIM domain is a specialized double-zinc finger motif found in a variety of proteins, in association with domains of divergent functions, such as the homeodomain (see the sunflower pollen-specific SF3 transcription factor: Baltz et al., *Plant J.* 2:713–721, 1992; or forming proteins composed primarily of LIM domains: Dawid et al., *Trends Genet.* 14[4]:156–162, 1998). LIM domains interact specifically with other LIM domains and with many different protein domains. LIM domains are thought to function as protein interaction modules, mediating specific contacts between members of functional complexes and modulating the activity of some of the constituent proteins. Nucleic acid binding by LIM domains, while suggested by structural considerations, remains an unproven possibility. However, it is possible that together with the homeodomain, the LIM domain could bind to the regulatory regions of developmentally controlled genes, as has been proposed for the paired box, a conserved sequence motif first identified in the paired (PRD) and gooseberry (GSB) homeodomain proteins from Drosophila (Triesman et al., *Genes Dev.* 5:594–604, 1991). The PRD box is also able to bind DNA in the absence of the homeodomain. LIM-domain proteins can be nuclear, cytoplasmic, or can shuttle between compartments. In the animal systems, several important LIM proteins have been shown to be associated with the cytoskeleton, having a role in adhesion-plaque and actin-microfilament organization. Among nuclear LIM proteins, the LIM homeodomain proteins form a major subfamily with important functions in cell lineage determination and pattern formation during animal development.

The AP2 (APETALA2) and EREBPs (ethylene-responsive element binding proteins) are the prototypic members of a family of transcription factors unique to plants, whose distinguishing characteristic is that they contain the so-called AP2 DNA-binding domain. AP2/EREBP genes form a large multigene family, and they play a variety of roles throughout the plant life cycle: from being key regulators of several developmental processes, like floral organ identity determination or control of leaf epidermal cell identity, to forming part of the mechanisms used by plants to respond to various types of biotic and environmental stress. In *Arabidopsis thaliana*, the homeotic gene APETALA2 (AP2) has been shown to control three salient processes during development: (1) the specification of flower organ identity and the regulation of floral organogenesis (Jofuku et al., *Plant Cell* 6:1211–1225, 1994); (2) establishment of flower meristem identity (Irish and Sussex, *Plant Cell* 2[8]:741–753, 1990); and (3) the temporal and spatial regulation of flower homeotic gene activity (Drews et al., *Cell* 65[6]:991–1002, 1991). DNA sequence analysis suggests that AP2 encodes a theoretical polypeptide of 432 aa, with a distinct 68 aa repeated motif termed the AP2 domain. This domain has been shown to be essential for AP2 functions and contains within the 68 aa, an eighteen amino acid core region that is predicted to form an amphipathic α-helix (Jofuku et al., *Plant Cell* 6:1211–1225, 1994). Ap2-like domain-containing transcription factors have been also been identified in both *Arabidopsis thaliana* (Okamuro et al., *Proc. Natl. Acad. Sci. USA* 94:7076–7081, 1997) and in tobacco with the identification of the ethylene responsive element binding proteins (EREBPs) (Ohme-Takagi and Shinshi, *Plant Cell* 7[2]:173–182, 1995). In Arabidopsis, these RAP2 (related to AP2) genes encode two distinct subfamilies of AP2 domain containing proteins designated AP2-like and EREBP-like (Okamuro et al., *Proc. Natl. Acad. Sci. USA* 94:7076–7081, 1997). In vitro DNA binding has not been shown to date using the RAP2 proteins; however, based upon the presence of two highly conserved motifs YRG and RAYD within the AP2 domain, it has been proposed that binding DNA binding occurs in a manner similar to that of AP2 proteins.

Zinc finger domains of the type $Cys_2His_2$ appear to represent the most abundant DNA binding motif in eukaryotic transcription factors, with several thousand being identified to date (Berg and Shi, *Science* 271[5252]:1081–1085, 1996). A structural role for zinc in transcription factors was initially proposed in 1983 for the transcription factor IIIA (TFIIIA) (Hanas et al., *J Biol. Chem.* 258[23]:14120–14125, 1983). The $Cys_2His_2$ Zinc finger domains are characterized by tandem arrays of sequences of C-x(2,4)-C-x(3)-[LIVMFYWC]-x(8)-H-x(3,5)-H (where X represents a variable amino acid). Structurally, the zinc finger consists of two antiparallel β strands followed by an a helix (Lee et al., *Science* 245[4918]:635–637, 1989). This structural arrangement allows for the cysteine and histidine side chains to coordinate the zinc with the three other conserved residues forming the hydrophobic core adjacent to the metal coordination unit (Berg and Shi, *Science* 271[5252]:1081–1085, 1996). Many proteins possessing a $Cys_2His_2$ domain have been shown to interact with DNA in a sequence-specific manner. Crystal structure analysis of the mouse transcription factor Zif268 bound to a specific DNA target indicates that the zinc fingers in the protein/DNA/DNA complex reside in the major groove of the double helix and interacts with the DNA bases through amino acid side chains referred to as the contact residues (Pavletich and Pabo, *Science* 252[5007]:809–817, 1991). The orientations of the zinc finger domains with respect to the DNA are usually identical, with each domain contacting a contiguous 3-base pair subsite, the majority of which are directed to one stand. There are few interdomain interactions and the DNA recognition by each zinc finger appears to be largely independent of the other domains (Berg and Shi, *Science* 271[5252]:1081–1085, 1996).

The CCAAT-box element identified by Gelinas et al. (*Nature* 313[6000]:323–325, 1985) has been shown to occur between 80 bp and 300 bp from the transcription start site and may operate in either orientation, with possible cooperative interactions with multiple boxes (Tasanen et al., *J Biol. Chem.* 267[16]:11513–11519, 1992); or other conserved motifs (Muro et al., *J. Biol. Chem.* 267[18]:12767–12774, 1992; Rieping and Schoffl, *Mol. Gen. Genet.* 231[2]:226–232, 1992). CCAAT-box related motifs have been identified in a number of promoters in a variety of organisms including yeast (Hahn et al., *Science* 240[4850]317–321, 1988), rat (Maity et al., *Proc. Natl. Acad. Sci. USA* 87[14]:5378–5382, 1990; Vuorio et al., *J. Biol. Chem.* 265[36]:22480–22486, 1990); and plants (Rieping and Schoffl. *Mol. Gen. Genet.* 231[2]:226–232, 1992; Kehoe et al., *Plant Cell* 6[8]:1123–1134, 1994). In both yeast and vertebrates, a protein complex has been shown to bind to the CCAAT-motif. In yeast the complex consists of three proteins, known as HAP2, HAP3 and HAP5 (Pinkham and Guarente, *Mol. Cell. Biol.* 5[12]:3410–3416, 1985).

MADS box transcription factors interact with a conserved region of DNA known as the MADS box. All MADS box transcription factors contain a conserved DNA-binding/dimerization region, known as the MADS domain, which has been identified throughout the different kingdoms (Riechmann and Meyerowitz, *Biol. Chem.* 378[10]:1079–1101, 1997). Many of the MADS box genes isolated from plants are expressed primarily in floral meristems or floral organs, and are believed to play a role in either specifying inflorescence and floral meristem identity or in determining floral organ identity. One class of regulatory genes responsible for floral meristem identity and the pattern of meristem development includes the genes APETALA1 (AP1), APETALA2 (AP2), CAULIFLOWER (CAL), LEAFY (LFY) and AGAMOUS (AG) from *Arabidopsis thaliana*. Both LFY and AP1 have been shown to encode putative transcription factors. (Weigel et al., *Cell* 69:843–859, 1992), with AP1 and AG each encoding putative transcription factors of the MADS box domain family (Yanofsky et al., *Nature* 346:35–39, 1990). Mutations in the Lfy gene have been shown to result in a partial conversion of flowers into infloresence shoots.

SUMMARY OF THE INVENTION

Briefly, the present invention provides polynucleotides isolated from plants that encode transcription factors, together with polypeptides encoded by such polynucleotides. The isolated polynucleotides and polypeptides of the present invention may be usefully employed in the modification of gene expression in plants, since both tissue- and temporal-specific gene expression patterns have been shown to be governed by transcription factors during the natural development of a plant. The inventive polynucleotides and polypeptides may thus be employed in the manipulation of plant phenotypes.

In a first aspect, the present invention provides polynucleotides isolated from eucalyptus and pine which encode transcription factors, including transcription factors from the following families of regulatory proteins: bZIP, bZIP family of G-box binding factors; basic helix-loop-helix zipper (bHLH); homeotic/homeodomain/homeobox/MADS; homeodomain zipper (ZIP); LIM domain; AP2 and EREBs; zinc finger domains of type Cys2His2; CCAAT box elements; and MYB. In specific embodiments, the isolated polynucleotides of the present invention comprise a DNA sequence selected from the group consisting of: (a) sequences recited in SEQ ID NOS: 1–591, 1183–1912 and 1931–2106; (b) complements of the sequences recited in SEQ ID NOS: 1–591, 1183–1912 and 1931–2106; (c) reverse complements of the sequences recited in SEQ ID NOS: 1–591, 1183–1912 and 1931–2106; (d) reverse sequences of the sequences recited in SEQ ID NOS: 1–591, 1183–1912 and 1931–2106; and (e) sequences having either 40%, 60%, 75%, 90% or 95% identity, as defined herein, to a sequence of (a)–(d).

In a further aspect, isolated polypeptides encoded by the inventive polynucleotides are provided. In specific embodiments, such polypeptides comprise an amino acid sequence selected from the group consisting of: (a) sequences provided in SEQ ID NOS: 592–1182, 1913–1930 and 2107–2278; and (b) polypeptides comprising sequences having either 60%, 75%, 90% or 95% identity, as defined herein, to a sequence of (a).

In another aspect, the present invention provides polypeptides isolated from eucalyptus and pine which comprise transcription factor DNA-binding domains. In specific embodiments, such polypeptides comprise an amino acid sequence selected from the group consisting of: (a) sequences provided in SEQ ID NOS: 2279–2293 and 2296–2368; and (b) sequences having either 60%, 75%, 90% or 95% identity, as defined herein, to a sequence of (a).

In a further aspect, the invention provides DNA constructs comprising a polynucleotide of the present invention, either alone, in combination with one or more other polynucleotides disclosed herein, or in combination with one or more known DNA sequences, together with transformed cells comprising such constructs.

In specific embodiments, the inventive DNA constructs comprise, in the 5'-3' direction, a gene promoter sequence; an open reading frame coding for at least a functional portion of a polypeptide encoded by an inventive polynucleotide, or a variant thereof; and a gene termination sequence. The open reading frame may be orientated in either a sense or antisense direction. DNA constructs comprising an untranslated, or non-coding, region of a polynucleotide coding for a transcription factor polypeptide of the present invention or a nucleotide sequence complementary to an untranslated region, together with a gene promoter sequence and a gene termination sequence, are also provided. Preferably, the gene promoter and termination sequences are functional in a host plant. Most preferably, the gene promoter and termination sequences are those of the original genes but others generally used in the art, such as the Cauliflower Mosaic Virus (CMV) promoter, with or without enhancers such as the Kozak sequence or Omega enhancer, and *Agrobacterium tumefaciens* nopalin synthase terminator may be usefully employed in the present invention. Tissue-specific promoters may be employed in order to target expression to one or more desired tissues. The DNA construct may further include a marker for the identification of transformed cells.

In yet a further aspect, transgenic cells comprising the DNA constructs of the present invention are provided, together with organisms, such as plants, comprising such transgenic cells. Fruits, seeds, derivatives, progeny, propagules and other products of such transgenic plants are also contemplated and encompassed by the present invention. As used herein, the term "propagule" means any part of a plant that may be used in reproduction or propagation, sexual or asexual, including cuttings.

In yet another aspect, methods for modifying gene expression in a target organism are provided, such methods including stably incorporating into the genome of the organism a DNA construct of the present invention. In a preferred embodiment, the target organism is a plant, preferably a woody plant, more preferably selected from the group consisting of eucalyptus and pine species, and most preferably from the group consisting of *Eucalyptus grandis* and *Pinus radiata*. In a related aspect, a method for producing a target organism, such as a plant, having modified gene expression is provided, the method comprising transforming a plant cell with a DNA construct of the present invention to provide a transgenic cell and cultivating the transgenic cell under conditions conducive to regeneration and mature plant growth.

The present invention further provides methods for modifying the activity of a transcription factor in a target organism, such as a plant, comprising stably incorporating into the genome of the plant a DNA construct of the present invention. In a preferred embodiment, the target plant is a woody plant, preferably selected from the group consisting of eucalyptus and pine species, and most preferably from the group consisting of *Eucalyptus grandis* and *Pinus radiata*.

The above-mentioned and additional features of the present invention and the manner of obtaining them will become apparent, and the invention will be best understood by reference to the following more detailed description. All references disclosed herein are hereby incorporated by reference in their entirety as if each was incorporated individually.

DETAILED DESCRIPTION OF THE INVENTION

The present invention provides isolated polynucleotides that encode plant transcription factors, together with isolated polypeptides encoded by such polynucleotides. As discussed above, transcription factors are components of the cellular "transcription apparatus" and are involved in the regulation of gene expression. Transcription factors are known to play a critical role in the growth and development of plants, and in cellular responses to external stimuli, such as environmental factors and disease pathogens. Transformation of plants with polynucleotides that encode proteins involved the cellular transcription process may thus be employed to modify properties such as lignin deposition, flower development, and male and female sterility.

Using the methods and materials of the present invention, the amount of a specific transcription factor may be increased or reduced by incorporating additional copies of polynucleotides, or fragments of said polynucleotides, encoding the transcription factor into the genome of a target organism, such as a plant. Similarly, an increase or decrease in the amount of the transcription factor may be obtained by transforming the target plant with antisense copies of such genes.

In one embodiment, the present invention provides isolated polynucleotides encoding, or partially encoding, plant transcription factors that are involved in the regulation of gene expression. The polynucleotides of the present invention were isolated from forestry plant sources, namely from *Eucalyptus grandis* and *Pinus radiata*, but they may alternatively be synthesized using conventional synthesis techniques. In specific embodiments, isolated polynucleotides of the present invention comprise a sequence selected from the group consisting of sequences identified as SEQ ID NOS: 1–591, 1183–1912 and 1931–2106; complements of the sequences identified as SEQ ID NOS: 1–591, 1183–1912 and 1931–2106; reverse complements of the sequences identified as SEQ ID NOS: 1–591, 1183–1912 and 1931–2106; reverse sequences of the sequences identified as SEQ ID NOS: 1–591, 1183–1912 and 1931–2106; sequences comprising at least a specified number of contiguous residues (x-mers) of any of the above-mentioned polynucleotides; extended sequences corresponding to any of the above polynucleotides; antisense sequences corresponding to any of the above polynucleotides; and variants of any of the above polynucleotides, as that term is described in this specification.

In another embodiment, the present invention provides isolated polypeptides encoded by the polynucleotides of SEQ ID NOS: 1–591, 1895–1912 and 1931–2106. In certain specific embodiments, such isolated polypeptides include a sequence selected from the group consisting of SEQ ID NOS: 592–1182, 1913–1930 and 2107–2278.

The inventive polynucleotides and polypeptides have demonstrated similarity to transformation factors that are known to be involved in regulation of transcription and/or expression in plants as shown below in Table 1.

TABLE 1

| Transcription factor family | Polynucleotide SEQ ID NO: |
|---|---|
| Basic leucine zipper (bZIP) | 133, 148, 194, 206, 246, 258, 261, 265, 279, 284, 285, 286, 290, 294, 303, 318, 331, 455, 470, 473, 497, 501, 512, 533, 538, 554, 558, 575, 1896–1899, 1938, 1939, 1950, 1958, 1959, 1961, 1963, 1969, 1973, 1981, 1983, 1989, 1991, 1998, 2002, 2004, 2021, 2022, 2025, 2028, 2029, 2033–2035, 2039, 2042, 2043, 2046, 2054, 2056, 2061, 2063, 2073, 2078, 2079, 2089, 2090, 2101, 2103, 2106 |
| bZIP family of G-box binding factors | 128, 136, 141, 142, 184, 202, 222, 244, 329, 541, 545 |
| Basic helix-loop-helix zipper | 157, 179, 223, 271, 274, 305, 317, 548, 563 |
| Myb | 138, 167, 214, 221, 232, 248, 252, 254, 255, 270, 276, 278, 280, 281, 282, 283, 292, 293, 315, 319, 328, 463, 483, 485, 486, 491, 492, 494, 502, 504, 507, 508, 510, 515, 518, 519, 520, 521, 527, 534, 536, 537, 540, 553, 559, 566, 572, 588, 1905, 1906, 1931, 1932, 1934–1936, 1940, 1948, 1949, 1951, 1953–1955, 1957, 1960, 1962, 1964–1968, 1974, 1975, 1977–1979, 1982, 1984–1988, 1992, 1994–1997, 2001, 2003, 2013–2015, 2024, 2026, 2027, 2030, 2032, 2036–2038, 2041, 2044, 2045, 2047– |

TABLE 1-continued

| Transcription factor family | Polynucleotide SEQ ID NO: |
|---|---|
| | 2049, 2051, 2052, 2057–2060, 2065, 2067, 2071, 2072, 2074–2077, 2080–2088, 2104, 2105 |
| Homeotic/homeodomain/ homeobox/MADS | 2, 3, 4, 7, 9, 10, 11, 12, 13, 17, 19, 25, 26, 27, 28, 29, 31, 32, 34, 35, 36, 37, 39, 40, 44, 45, 49, 50, 51, 52, 54, 55, 57, 60, 62, 63, 64, 65, 66, 69, 72, 74, 76, 77, 79, 82, 84, 88, 89, 92, 94, 96, 97, 98, 100, 102, 103, 104, 105, 106, 107, 108, 11, 112, 114, 116, 117, 123, 125, 127, 168, 185, 249, 250, 332, 333, 334, 336, 337, 338, 340, 341, 343, 344, 345, 346, 347, 348, 349, 350, 351, 353, 354, 355, 356, 357, 359, 360, 361, 362, 364, 365, 366, 367, 368, 370, 371, 372, 373, 374, 375, 376, 379, 380, 383, 384, 385, 386, 387, 389, 392, 393, 394, 398, 399, 400, 401, 402, 403, 406, 408, 409, 410, 412, 414, 416, 417, 418, 420, 422, 424, 425, 426, 475, 526, 529, 580, 591, 1901, 1902, 1937, 1941–1947, 1952, 1970–1972, 1976, 1980, 1990, 1993, 1999, 2000, 2006–2012, 2016–2020, 2023, 2031, 2040, 2050, 2053, 2055, 2062, 2064, 2066, 2068–2070, 2091–2100 |
| Homeodomain zipper (HDZIP) | 1, 5, 6, 14, 16, 20, 21, 22, 23, 30, 33, 41, 42, 47, 58, 59, 61, 68, 70, 71, 73, 75, 80, 86, 87, 90, 91, 93, 115, 119, 121, 126, 335, 339, 342, 352, 358, 363, 369, 377, 381, 388, 390, 396, 397, 415, 419, 421, 423, 2005, 2102 |
| LIM domain | 15, 18, 24, 43, 78, 81, 83, 198, 210, 225, 273, 378, 391, 433, 437, 450, 452 |
| AP2 and EREBs | 120, 124, 170, 171, 219, 220, 224, 226, 229, 230, 238, 242, 243, 245, 247, 256, 301, 320, 330, 432, 434, 435, 436, 445, 447, 451, 453, 454, 459, 466, 469, 476, 481, 490, 524, 546, 549, 570, 1895 |
| Zinc finger domains of type Cys2His2 | 132, 146, 154, 180, 181, 182, 183, 191, 207, 227, 234, 288, 323, 324, 325, 326, 404, 535, 567, 584, 585, 586, 587, 589, 590 |
| CCAAT box elements | 155, 174, 266, 309, 431, 460, 484, 499, 542, 551, 574, 583 |
| Other transcription factors | 8, 38, 46, 48, 53, 56, 67, 85, 95, 99, 101, 109, 110, 113, 118, 122, 129, 130, 131, 134, 135, 137, 139, 140, 143, 1444, 145, 147, 149, 150, 151, 152, 153, 156, 158, 159, 160, 161, 162, 163, 164, 165, 166, 169, 172, 173, 175, 176, 177, 178, 186, 187, 188, 189, 190, 192, 193, 195, 196, 197, 199, 200, 201, 203, 204, 205, 208, 209, 211, 212, 213, 215, 216, 217, 218, 228, 231, 233, 235, 236, 237, 239, 240, 241, 251, 253, 257, 259, 260, 262, 263, 264, 267, 268, 269, 272, 275, 277, 287, 289, 291, 295, 296, 297, 298, 299, 300, 302, 304, 306, 307, 308, 310, 311, 312, 313, 314, 316, 321, 322, 327, 382, 395, 405, 407, 411, 413, 4127, 428, 429, 430, 438, 439, 440, 441, 442, 443, 444, 446, 449, 456, 457, 458, 461, 462, 464, 465, 467, 468, 471, 472, 474, 477, 478, 479, 480, 482, 487, 488, 489, 493, 495, 496, 498, 500, 505, 506, 509, 511, 513, 514, 516, 517, 522, 523, 525, 528, 530, 531, 532, 539, 543, 544, 547, 550, 552, 555, 556, 557, 560, 561, 562, 564, 565, 568, 569, 571, 573, 577, 578, 579, 581, 582, 448, 1183–1894, 1900, 1903, 1904, 1907, 1908–1912, 1933, 1956 |

The term "polynucleotide(s)," as used herein, means a single or double-stranded polymer of deoxyribonucleotide or ribonucleotide bases and includes DNA and corresponding RNA molecules, including HnRNA and mRNA molecules, both sense and anti-sense strands, and comprehends cDNA, genomic DNA and recombinant DNA, as well as wholly or partially synthesized polynucleotides. An HnRNA molecule contains introns and corresponds to a DNA molecule in a generally one-to-one manner. An mRNA molecule corresponds to an HnRNA and DNA molecule from which the introns have been excised. A polynucleotide may consist of an entire gene, or any portion thereof. Operable anti-sense polynucleotides may comprise a fragment of the corresponding polynucleotide, and the definition of "polynucleotide" therefore includes all such operable anti-sense fragments. Anti-sense polynucleotides and techniques involving anti-sense polynucleotides are well known in the art and are described, for example, in Robinson-Benion et al., "Antisense techniques," *Methods in Enzymol.* 254[23]:363–375, 1995; and Kawasaki et al., *Artific. Organs* 20[8]:836–848, 1996.

The definition of the terms "complement", "reverse complement" and "reverse sequence", as used herein, is best illustrated by the following example. For the sequence 5' AGGACC 3', the complement, reverse complement and reverse sequence are as follows:

| complement | 3' TCCTGG 5' |
| reverse complement | 3' GGTCCT 5' |
| reverse sequence | 5' CCAGGA 3'. |

The term "polypeptide", as used herein, encompasses amino acid chains of any length including full length proteins, wherein amino acid residues are linked by covalent peptide bonds. Polypeptides of the present invention may be naturally purified products, or may be produced partially or wholly using recombinant techniques. The term "polypeptide encoded by a polynucleotide" as used herein, includes polypeptides encoded by a nucleotide sequence which includes the partial isolated DNA sequences of the present invention.

All of the polynucleotides and polypeptides described herein are isolated and purified, as those terms are commonly used in the art. Preferably, the polypeptides and polynucleotides are at least about 80% pure, more preferably at least about 90% pure, and most preferably at least about 99% pure.

Some of the polynucleotides of the present invention are "partial" sequences, in that they do not represent a full length gene encoding a full length polypeptide. Such partial sequences may be extended by analyzing and sequencing various DNA libraries using primers and/or probes and well known hybridization and/or PCR techniques. Partial sequences may be extended until an open reading frame encoding a polypeptide, a full length polynucleotide and/or gene capable of expressing a polypeptide, or another useful portion of the genome is identified. Such extended sequences, including full length polynucleotides and genes, are described as "corresponding to" a sequence identified as one of the sequences of SEQ ID NOS: 1–591, 1183–1912 and 1931–2106, or a variant thereof, or a portion of one of the sequences of SEQ ID NOS: 1–591, 1183–1912 and 1931–2106, or a variant thereof, when the extended polynucleotide comprises an identified sequence or its variant, or an identified contiguous portion (x-mer) of one of the sequences of SEQ ID NOS: 1–591, 1183–1912 and 1931–2106, or a variant thereof. Such extended polynucleotides may have a length of from about 50 to about 4,000 nucleic acids or base pairs, and preferably have a length of less than about 4,000 nucleic acids or base pairs, more preferably yet a length of less than about 3,000 nucleic acids or base pairs, more preferably yet a length of less than about 2,000 nucleic acids or base pairs. Under some circumstances, extended polynucleotides of the present invention may have a length of less than about 1,800 nucleic acids or base pairs, preferably less than about 1,600 nucleic acids or base pairs, more preferably less than about 1,400 nucleic acids or base pairs, more preferably yet less than about 1,200 nucleic acids or base pairs, and most preferably less than about 1,000 nucleic acids or base pairs.

Similarly, RNA sequences, reverse sequences, complementary sequences, antisense sequences, and the like, corresponding to the polynucleotides of the present invention, may be routinely ascertained and obtained using the cDNA sequences identified as SEQ ID NOS: 1–591, 1183–1912 and 1931–2106.

The polynucleotides identified as SEQ ID NOS: 1–591, 1183–1912 and 1931–2106 may contain open reading frames ("ORFs") or partial open reading frames encoding polypeptides. Open reading frames may be identified using techniques that are well known in the art. These techniques include, for example, analysis for the location of known start and stop codons, most likely reading frame identification based on codon frequencies, etc. Suitable tools and software for ORF analysis are available, for example, on the Internet. Additional tools and software for ORF analysis include GeneWise, available from The Sanger Center, Wellcome Trust Genome Campus, Hinxton, Cambridge, CB10 1SA, United Kingdom; Diogenes, available from Computational Biology Centers, University of Minnesota, Academic Health Center, UMHG Box 43 Minneapolis Minn. 55455; and GRAIL, available from the Informatics Group, Oak Ridge National Laboratories, Oak Ridge, Tennessee Tenn. Open reading frames and portions of open reading frames may be identified in the polynucleotides of the present invention. Once a partial open reading frame is identified, the polynucleotide may be extended in the area of the partial open reading frame using techniques that are well known in the art until the polynucleotide for the full open reading frame is identified. Thus, open reading frames encoding polypeptides may be identified using the polynucleotides of the present invention.

Once open reading frames are identified in the polynucleotides of the present invention, the open reading frames may be isolated and/or synthesized. Expressible DNA constructs comprising the open reading frames and suitable promoters, initiators, terminators, etc., which are well known in the art, may then be constructed. Such DNA constructs may be introduced into a host cell to express the polypeptide encoded by the open reading frame. Suitable host cells may include various prokaryotic and eukaryotic cells, including plant cells, mammalian cells, bacterial cells, algae and the like.

Polypeptides encoded by the polynucleotides of the present invention may be expressed and used in various assays to determine their biological activity. Such polypeptides may be used to raise antibodies, to isolate corresponding interacting proteins or other compounds, and to quantitatively determine levels of interacting proteins or other compounds.

As used herein, the term "variant" comprehends nucleotide or amino acid sequences different from the specifically identified sequences, wherein one or more nucleotides or amino acid residues is deleted, substituted, or added. Variants may be naturally occurring allelic variants, or non-naturally occurring variants. Variant sequences, (polynucleotide or polypeptide) preferably exhibit at least 50%, more preferably at least 75%, more preferably at least 90% and most preferably at least 95% identity to a sequence of the present invention. The percentage identity is determined by aligning the two sequences to be compared as described below, determining the number of identical residues in the aligned portion, dividing that number by the total number of residues in the inventive (queried) sequence, and multiplying the result by 100. By way of illustration only, assume an inventive polynucleotide having 220 nucleotides has a hit to a polynucleotide sequence in the EMBL database having 520 nucleotides over a stretch of 23 nucleotides in the alignment produced by the BLASTN algorithm using the parameters described above. The 23 nucleotide region includes 21 identical nucleotides, one gap and one different nucleotide. The percentage identity of the inventive polynucleotide to the hit in the EMBL library is thus 21/220 times 100, or 9.5%. The polynucleotide sequence in the EMBL database is thus not a variant of the inventive polynucleotide.

Polynucleotide and polypeptide sequences may be aligned, and percentage of identical residues in a specified region may be determined against another polynucleotide or polypeptide sequence, using computer algorithms that are publicly available. Two exemplary algorithms for aligning and identifying the similarity of polynucleotide sequences are the BLASTN and FASTA algorithms. Polynucleotides may also be analyzed using the BLASTX algorithm, which compares the six-frame conceptual translation products of a nucleotide query sequence (both strands) against a protein sequence database. The similarity of polypeptide sequences may be examined using the BLASTP algorithm. The BLASTN, BLASTX and BLASTP programs are available on the NCBI anonymous FTP server under/blast/executables, and from the National Center for Biotechnology Information (NCBI) National Library of Medicine, Building 38A, Room 8N805, Bethesda, Md. 20894, USA. The BLASTN algorithm Version 2.0.4 [Feb. 24, 1998] and Version 2.0.6 [Sep. 16, 1998], set to the default parameters described in the documentation and distributed with the algorithm, are preferred for use in the determination of polynucleotide variants according to the present invention. The BLASTP algorithm, is preferred for use in the determination of polypeptide variants according to the present invention. The use of the BLAST family of algorithms, including BLASTN, BLASTP, and BLASTX, is described at NCBI's Internet website and in the publication of Altschul et al., *Nucleic Acids Res.* 25:3389–3402, 1997.

The computer algorithm FASTA is available on the Internet, and from the University of Virginia by contacting David Hudson, Assistance Provost for Research, University of Virginia, PO Box 9025, Charlottesville, Va. Version 2.0u4 [February 1996], set to the default parameters described in the documentation and distributed with the algorithm, may be used in the determination of variants according to the present invention. The use of the FASTA algorithm is described in Pearson and Lipman, *Proc. Natl. Acad. Sci. USA* 85:2444–2448, 1988; and Pearson, *Methods in Enzymol.* 183:63–98, 1990.

The following running parameters are preferred for determination of alignments and similarities using BLASTN that contribute to the E values and percentage identity for polynucleotide sequences: Unix running command: blastall -p blastn -d embldb -e 10-G0-E0 -r 1 -v 30 -b 30 -i queryseq -o results; the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -r Reward for a nucleotide match (blastn only) [Integer]; -v Number of one-line descriptions (V) [Integer]; -b Number of alignments to show (B) [Integer]; -i Query File [File In]; and -o Blast report Output File [File Out] Optional.

The following running parameters are preferred for determination of alignments and similarities using BLASTP that contribute to the E values and percentage identity of polypeptide sequences: blastall -p blastp -d swissprotdb -e 10 -G 0 -E 0 -v 30 -b 30 -i queryseq -o results; wherein the parameters are: -p Program Name [String]; -d Database [String]; -e Expectation value (E) [Real]; -G Cost to open a gap (zero invokes default behavior) [Integer]; -E Cost to extend a gap (zero invokes default behavior) [Integer]; -v Number of one-line descriptions (v) [Integer]; -b Number of alignments to show (b) [Integer]; -I Query File [File In]; -o BLAST report Output File [File Out] Optional.

The "hits" to one or more database sequences by a queried sequence produced by BLASTN, FASTA, BLASTP or a similar algorithm, align and identify similar portions of sequences. The hits are arranged in order of the degree of similarity and the length of sequence overlap. Hits to a database sequence generally represent an overlap over only a fraction of the sequence length of the queried sequence.

The BLASTN, FASTA and BLASTP algorithms also produce "Expect" values for alignments. The Expect value (E) indicates the number of hits one can "expect" to see over a certain number of contiguous sequences by chance when searching a database of a certain size. The Expect value is used as a significance threshold for determining whether the hit to a database, such as the preferred EMBL database, indicates true similarity. For example, an E value of 0.1 assigned to a polynucleotide hit is interpreted as meaning that in a database of the size of the EMBL database, one might expect to see 0.1 matches over the aligned portion of the sequence with a similar score simply by chance. By this criterion, the aligned and matched portions of the polynucleotide sequences then have a probability of 90% of being the same. For sequences having an E value of 0.01 or less over aligned and matched portions, the probability of finding a match by chance in the EMBL database is 1% or less using the BLASTN or FASTA algorithm.

According to one embodiment, "variant" polynucleotides and polypeptides, with reference to each of the polynucleotides and polypeptides of the present invention, preferably comprise sequences having the same number or fewer nucleic or amino acids than each of the polynucleotides or polypeptides of the present invention and producing an E value of 0.01 or less when compared to the polynucleotide or polypeptide of the present invention. That is, a variant polynucleotide or polypeptide is any sequence that has at least a 99% probability of being the same as the polynucleotide or polypeptide of the present invention, measured as having an E value of 0.01 or less using the BLASTN, FASTA, or BLASTP algorithms set at parameters described above.

Alternatively, variant polynucleotides of the present invention hybridize to the polynucleotide sequences recited in SEQ ID NOS: 1–591, 1183–1912 and 1931–2106, or complements, reverse sequences, or reverse complements of those sequences, under stringent conditions. As used herein, "stringent conditions" refers to prewashing in a solution of 6×SSC, 0.2% SDS; hybridizing at 65° C., 6×SSC, 0.2% SDS overnight; followed by two washes of 30 minutes each in 1×SSC, 0.1% SDS at 65° C. and two washes of 30 minutes each in 0.2×SSC, 0.1 % SDS at 65° C.

The present invention also encompasses polynucleotides that differ from the disclosed sequences but that, as a consequence of the degeneracy of the genetic code, encode a polypeptide which is the same as that encoded by a polynucleotide of the present invention. Thus, polynucleotides comprising sequences that differ from the polynucleotide sequences recited in SEQ ID NOS: 1–591, 1183–1912 and 1931–2106; or complements, reverse sequences, or reverse complements thereof, as a result of conservative substitutions are contemplated by and encompassed within the present invention. Additionally, polynucleotides comprising sequences that differ from the polynucleotide sequences recited in SEQ ID NOS: 1–591, 1183–1912 and 1931–2106, or complements, reverse complements or reverse sequences thereof, as a result of deletions and/or insertions totaling less than 10% of the total sequence length are also contemplated by and encompassed within the present invention. Similarly, polypeptides comprising sequences that differ from the polypeptide sequences recited in SEQ ID NOS: 592–1182, 1913–1930 and 2107–2278, as a result of amino acid substitutions, insertions, and/or deletions totaling less than 10% of the total sequence length are contemplated by and encompassed within the present invention. In certain embodiments, variants of the inventive polypeptides possess biological activities that are the same or similar to those of the inventive polypeptides. Such variant polypeptides function as transcription factors and are thus capable of modifying gene expression in a plant. Similarly, variant polynucleotides may encode polypeptides that function as transcription factors.

In addition to having a specified percentage identity to an inventive polynucleotide or polypeptide sequence, variant polynucleotides and polypeptides preferably have additional structure and/or functional features in common with the inventive polynucleotide or polypeptide. Polypeptides having a specified degree of identity to a polypeptide of the present invention share a high degree of similarity in their primary structure and have substantially similar functional properties. In addition to sharing a high degree of similarity in their primary structure to polynucleotides of the present invention, polynucleotides having a specified degree of identity to, or capable of hybridizing to an inventive polynucleotide preferably have at least one of the following features: (i) they contain an open reading frame or partial open reading frame encoding a polypeptide having substantially the same functional properties as the polypeptide encoded by the inventive polynucleotide; or (ii) they contain identifiable domains in common.

Polynucleotides of the present invention also comprehend polynucleotides comprising at least a specified number of contiguous residues (x-mers) of any of the polynucleotides identified as SEQ ID NOS: 1–591, 1183–1912 and 1931–2106, complements, reverse sequences, and reverse complements of such sequences, and their variants. Similarly, polypeptides of the present invention comprehend polypeptides comprising at least a specified number of contiguous residues (x-mers) of any of the polypeptides identified as SEQ ID NOS: 592–1182, 1913–1930 and 2107–2278, and their variants. As used herein, the term "x-mer," with reference to a specific value of "x," refers to a sequence comprising at least a specified number ("x") of contiguous residues of any of the polynucleotides identified as SEQ ID NOS: 1–591, 1183–1912 and 1931–2106, or the polypeptides identified as SEQ ID NOS: 592–1182, 1913–1930 and 2107–2278. According to preferred embodiments, the value of x is preferably at least 20, more preferably at least 40, more preferably yet at least 60, and most preferably at least 80. Thus, polynucleotides and polypeptides of the present invention comprise a 20-mer, a 40-mer, a 60-mer, an 80-mer, a 100-mer, a 120-mer, a 150-mer, a 180-mer, a 220-mer, a 250-mer, a 300-mer, a 400-mer, a 500-mer or a 600-mer of a polynucleotide or polypeptide identified as SEQ ID NOS: 1–2368, and variants thereof.

The inventive polynucleotides may be isolated by high throughput sequencing of cDNA libraries prepared from *Eucalyptus grandis* and *Pinus radiata* as described below in Examples 1 and 2. Alternatively, oligonucleotides based on the sequences provided in SEQ ID NOS: 1–591, 1183–1912 and 1931–2106 may be prepared as detailed below and used to identify positive clones in either cDNA or genomic DNA libraries from *Eucalyptus grandis* and *Pinus radiata* by means of hybridization or PCR techniques. Probes may be shorter than the sequences provided herein but should be at least about 10, preferably at least 15, and most preferably at least about 20 nucleotides in length. Hybridization and PCR techniques suitable for use with such oligonucleotides are well known in the art, and include those taught by Sambrook et al., Ibid. Positive clones may be analyzed by restriction enzyme digestion, DNA sequencing or the like.

The polynucleotides of the present invention may alternatively be synthesized using techniques that are well known in the art. The polynucleotides may be synthesized, for example, using automated oligonucleotide synthesizers (e.g., Beckman Oligo 1000M DNA Synthesizer) to obtain polynucleotide segments of up to 50 or more nucleic acids. A plurality of such polynucleotide segments may then be ligated using standard DNA manipulation techniques that are well known in the art of molecular biology. One conventional and exemplary polynucleotide synthesis technique involves synthesis of a single stranded polynucleotide segment having, for example, 80 nucleic acids, and hybridizing that segment to a synthesized complementary 85 nucleic acid segment to produce a 5 nucleotide overhang. The next segment may then be synthesized in a similar fashion, with a 5 nucleotide overhang on the opposite strand. The "sticky" ends ensure proper ligation when the two portions are hybridized. In this way, a complete polynucleotide of the present invention may be sized entirely in vitro.

In certain embodiments, the DNA constructs of the present invention include an open reading frame coding for at least a functional portion of a polypeptide of the present invention or a variant thereof. As used herein, the "functional portion" of a polypeptide is that portion which contains the active site essential for regulating gene expression, i.e., the portion of the molecule that is capable of binding to, or interacting with, the promoter of the gene to be expressed. The DNA-binding domain(s) for certain of the inventive polypeptides are identified below in Table 2. These DNA binding domains were identified using PROSITE 15.0 pattern or profile sequences as listed in the PROSITE database. PROSITE is available on the Internet and its use is described in Hofman et al., *Nucleic Acids Res.* 27:215–219, 1999; and in Bairoch, *Nucleic Acids Res.* 20:Suppl.2013–2018, 1992.

TABLE 2

| Polynucleotide SEQ ID NO: | DNA-binding Domain(s) SEQ ID NO: |
| --- | --- |
| 1931 | 2283 |
| 1934 | 2284, 2285 |
| 1940 | 2288 |
| 1949 | 2293 |
| 1951 | 2279, 2280 |
| 1953 | 2296, 2297 |

TABLE 2-continued

| Polynucleotide SEQ ID NO: | DNA-binding Domain(s) SEQ ID NO: |
|---|---|
| 1957 | 2298 |
| 1960 | 2301, 2302 |
| 1962 | 2307 |
| 1965 | 2308, 2309 |
| 1967 | 2281, 2282 |
| 1978 | 2320 |
| 1979 | 2321 |
| 1982 | 2322, 2323 |
| 1986 | 2324 |
| 1992 | 2335 |
| 1994 | 2336, 2337 |
| 1995 | 2338, 2339 |
| 1997 | 2340 |
| 2003 | 2286, 2287 |
| 2013 | 2289, 2290 |
| 2020 | 2291, 2292 |
| 2027 | 2299, 2300 |
| 2030 | 2303, 2304 |
| 2032 | 2305, 2306 |
| 2036 | 2310, 2311 |
| 2038 | 2312, 2313 |
| 2049 | 2314, 2315 |
| 2051 | 2316, 2317 |
| 2052 | 2318, 2319 |
| 2057 | 2325, 2326 |
| 2059 | 2327, 2328 |
| 2060 | 2329, 2330 |
| 2065 | 2331, 2332 |
| 2067 | 2333, 2334 |
| 2074 | 2342, 2343 |
| 2075 | 2344, 2345 |
| 2076 | 2346, 2347 |
| 2077 | 2348, 2349 |
| 2080 | 2352 |
| 2081 | 2353 |
| 2082 | 2354 |
| 2083 | 2355, 2356 |
| 2084 | 2357, 2358 |
| 2085 | 2359, 2360 |
| 2086 | 2361, 2362 |
| 2087 | 2365, 2366 |
| 2088 | 2367, 2368 |
| 2104 | 2350, 2351 |
| 2105 | 2363, 2364 |

The functional portion of a polypeptide may also be determined by targeted mutagenesis and screening of modified protein products with protocols well known in the art (Solano et al., *J. Biol. Chem.* 272:2889–95, 1997). The active site will generally exhibit high substrate specificity. Portions of the inventive polypeptides may be generated by synthetic or recombinant means. Synthetic polypeptides having fewer than about 100 amino acids, and generally fewer than about 50 amino acids, may be generated using techniques well known to those of ordinary skill in the art. For example, such polypeptides may be synthesized using any of the commercially available solid-phase techniques, such as the Merrifield solid-phase synthesis method, where amino acids are sequentially added to a growing amino acid chain. See Merrifield, *J. Am. Chem. Soc.* 85:2149–2154, 1963. Equipment for automated synthesis of polypeptides is commercially available from suppliers such as Perkin Elmer/Applied BioSystems, Inc. (Foster City, Calif.), and may be operated according to the manufacturer's instructions.

An open reading frame may be inserted in the DNA construct in a sense or antisense orientation, such that transformation of a target plant with the DNA construct will lead to a change in the amount of polypeptide compared to the wild-type plant. Transformation with a DNA construct comprising an open reading frame in a sense orientation will generally result in over-expression of the selected gene, while transformation with a DNA construct comprising an open reading frame in an antisense orientation will generally result in reduced expression of the selected gene. A population of plants transformed with a DNA construct comprising an open reading frame of the present invention in either a sense or antisense orientation may be screened for increased or reduced expression of the gene in question using techniques well known to those of skill in the art, and plants having the desired phenotypes may thus be isolated.

Alternatively, expression of a gene encoding a plant transcription factor may be inhibited by inserting a portion of an open reading frame of the present invention, in either sense or antisense orientation, in the DNA construct. Such portions need not be full-length but preferably comprise at least 25 and more preferably at least 50 residues of an inventive DNA sequence. A much longer portion or even the full length DNA corresponding to the complete open reading frame may be employed. The portion of the open reading frame does not need to be precisely the same as the endogenous sequence, provided that there is sufficient sequence similarity to achieve inhibition of the target gene. Thus a sequence derived from one species may be used to inhibit expression of a gene in a different species. A population of plants transformed with a genetic construct comprising an open reading frame of the present invention in either a sense or antisense orientation may be screened for increased or reduced expression of the gene in question using techniques well known to those of skill in the art, and plants having the desired phenotypes may thus be isolated.

In another embodiment, the inventive DNA constructs comprise a DNA sequence including an untranslated, or non-coding, region of a gene coding for a polypeptide of the present invention, or a DNA sequence complementary to such an untranslated region. Examples of untranslated regions which may be usefully employed in such constructs include introns and 5'-untranslated leader sequences. Transformation of a target plant with such a DNA construct may lead to a reduction in the amount of the polypeptide expressed in the plant by the process of cosuppression, in a manner similar to that discussed, for example, by Napoli et al. (*Plant Cell* 2:279–290, 1990), and de Carvalho Niebel et al. (Plant Cell 7:347–358, 1995).

Alternatively, regulation of polypeptide expression can be achieved by inserting appropriate sequences or subsequences (e.g. DNA or RNA) in ribozyme constructs (McIntyre and Manners, *Transgenic Res.* 5[4]:257–262, 1996). Ribozymes are synthetic RNA molecules that comprise a hybridizing region complementary to two regions, each of which comprises at least 5 contiguous nucleotides in a mRNA molecule encoded by one of the inventive polynucleotides. Ribozymes possess highly specific endonuclease activity, which autocatalytically cleaves the mRNA.

The DNA constructs of the present invention further comprise a gene promoter sequence and a gene termination sequence, operably linked to the DNA sequence to be transcribed, which control expression of the gene. The gene promoter sequence is generally positioned at the 5' end of the DNA sequence to be transcribed, and is employed to initiate transcription of the DNA sequence. Gene promoter sequences are generally found in the 5' untranslated region of a gene but they may exist downstream of the open reading frame, in introns (Luehrsen, *Mol. Gen. Genet.* 225:81–93, 1991) or in the coding region, as for example in a plant defence gene (Douglas et al., *EMBO J.* 10:1767–1775, 1991). When the construct includes an open reading frame in a sense orientation, the gene promoter sequence also initiates translation of the open reading frame. For DNA constructs comprising either an open reading frame in an antisense orientation or an untranslated region, the gene promoter sequence may consist only of a transcription initiation site having a RNA polymerase binding site.

A variety of gene promoter sequences which may be usefully employed in the DNA constructs of the present invention are well known in the art. The gene promoter sequence, and also the gene termination sequence, may be endogenous to the target plant host or may be exogenous, provided the promoter is functional in the target host. For example, the promoter and termination sequences may be from other plant species, plant viruses, bacterial plasmids and the like. Preferably, gene promoter and termination sequences are from the inventive sequences themselves.

Factors influencing the choice of promoter include the desired tissue specificity of the construct, and the timing of transcription and translation. For example, constitutive promoters, such as the 35S Cauliflower Mosaic Virus (CaMV 35S) promoter, will affect the activity of the enzyme in all parts of the plant. Use of a tissue specific promoter will result in production of the desired sense or antisense RNA only in the tissue of interest. With DNA constructs employing inducible gene promoter sequences, the rate of RNA polymerase binding and initiation can be modulated by external stimuli, such as light, heat, anaerobic stress, alteration in nutrient conditions and the like. Temporally regulated promoters can be employed to effect modulation of the rate of RNA polymerase binding and initiation at a specific time during development of a transformed cell. Preferably, the original promoters from the enzyme gene in question, or promoters from a specific tissue-targeted gene in the organism to be transformed, such as eucalyptus or pine are used. Other examples of gene promoters which may be usefully employed in the present invention include mannopine synthase (mas), octopine synthase (ocs) and those reviewed by Chua et al. (*Science* 244:174–181, 1989).

The gene termination sequence, which is located 3' to the DNA sequence to be transcribed, may come from the same gene as the gene promoter sequence or may be from a different gene. Many gene termination sequences known in the art may be usefully employed in the present invention, such as the 3' end of the *Agrobacterium tumefaciens* nopaline synthase gene. However, preferred gene terminator sequences are those from the original gene or from the target species to be transformed.

The DNA constructs of the present invention may also contain a selection marker that is effective in cells of the target organism, such as a plant, to allow for the detection of transformed cells containing the inventive construct. Such markers, which are well known in the art, typically confer resistance to one or more toxins. One example of such a marker is the NPTII gene whose expression results in resistance to kanamycin or hygromycin, antibiotics which are usually toxic to plant cells at a moderate concentration (Rogers et al., in Weissbach, A and Weissbach H, eds., *Methods for Plant Molecular Biology*, Academic Press Inc.: San Diego, Calif., 1988). Transformed cells can thus be identified by their ability to grow in media containing the antibiotic in question. Alternatively, the presence of the desired construct in transformed cells can be determined by means of other techniques well known in the art, such as Southern and Western blots.

A transcription initiation site is additionally included in the DNA construct when the sequence to be transcribed lacks such a site.

Techniques for operatively linking the components of the inventive DNA constructs are well known in the art and include the use of synthetic linkers containing one or more restriction endonuclease sites as described, for example, by Sambrook et al., (*Molecular cloning: a laboratory manual*, CSHL Press: Cold Spring Harbor, N.Y., 1989). The DNA construct of the present invention may be linked to a vector having at least one replication system, for example *E. coli*, whereby after each manipulation, the resulting construct can be cloned and sequenced and the correctness of the manipulation determined.

The DNA constructs of the present invention may be used to transform a variety of target organisms including, but not limited to, plants. Plants which may be transformed using the inventive constructs include both monocotyledonous angiosperms (e.g., grasses, corn, grains, oat, wheat and barley); and dicotyledonous angiosperms (e.g., Arabidopsis, tobacco, legumes, alfalfa, oaks, eucalyptus, maple); and Gymnosperms (e.g., Scots pine (Aronen, *Finnish Forest Res. Papers*, Vol. 595, 1996); white spruce (Ellis et al., *Biotechnology* 11:84–89, 1993); and larch (Huang et al., *In Vitro Cell* 27:201–207, 1991). In a preferred embodiment, the inventive DNA constructs are employed to transform woody plants, herein defined as a tree or shrub whose stem lives for a number of years and increases in diameter each year by the addition of woody tissue. Preferably the target plant is selected from the group consisting of eucalyptus and pine species, most preferably from the group consisting of *Eucalyptus grandis* and *Pinus radiata*. Other species which may be usefully transformed with the DNA constructs of the present invention include, but are not limited to; pines such as *Pinus banksiana, Pinus brutia, Pinus caribaea, Pinus clausa, Pinus contorta, Pinus coulteri, Pinus echinata, Pinus eldarica, Pinus ellioti, Pinus jefreyi, Pinus lambertiana, Pinus monticola, Pinus nigra, Pinus palustrus, Pinus pinaster, Pinus ponderosa, Pinus resinosa, Pinus rigida, Pinus serotina, Pinus strobus, Pinus sylvestris, Pinus taeda, Pinus virginiana;* other gymnosperms, such as *Abies amabilis, Abies balsamea, Abies concolor, Abies grandis, Abies lasiocarpa, Abies magnifica, Abies procera, Chamaecyparis lawsoniona, Chamaecyparis nootkatensis, Chamaecyparis thyoides, Huniperus virginiana, Larix decidua, Larix laricina, Larix leptolepis, Larix occidentalis, Larix siberica, Libocedrus decurrens, Picea abies, Picea engelmanni, Picea glauca, Picea mariana, Picea pungens, Picea rubens, Picea sitchensis, Pseudotsuga menziesii, Sequoia gigantea, Sequoia sempervirens, Taxodium distichum, Tsuga canadensis, Tsuga heterophylla, Tsuga mertensiana, Thuja occidentalis, Thuja plicata;* and Eucalypts, such as *Eucalyptus alba, Eucalyptus bancroftii, Eucalyptus botyroides, Eucalyptus bridgesiana, Eucalyptus calophylla, Eucalyptus camaldulensis, Eucalyptus citriodora, Eucalyptus cladocalyx, Eucalyptus coccifera, Eucalyptus curtisii, Eucalyptus dalrympleana, Eucalyptus deglupta, Eucalyptus delagatensis, Eucalyptus diversicolor, Eucalyptus dunnii, Eucalyptus ficifolia, Eucalyptus globulus, Eucalyptus gomphocephala, Eucalyptus gunnii, Eucalyptus henryi, Eucalyptus laevopinea, Eucalyptus macarthurii, Eucalyptus macrorhyncha, Eucalyptus maculata, Eucalyptus marginata, Eucalyptus megacarpa, Eucalyptus melliodora, Eucalyptus nichoiji, Eucalyptus nitens, Eucalyptus nova-anglica, Eucalyptus obliqua, Eucalyptus obtusiflora, Eucalyptus oreades, Eucalyptus pauciflora, Eucalyptus polybractea, Eucalyptus regnans, Eucalyptus resinifera, Eucalyptus robusta, Eucalyptus rudis, Eucalyptus saligna, Eucalyptus sideroxylon, Eucalyptus stuartiana, Eucalyptus tereticornis, Eucalyptus*

*torelliana, Eucalyptus urnigera, Eucalyptus urophylla, Eucalyptus viminalis, Eucalyptus viridis, Eucalyptus wandoo* and *Eucalyptus youmanni;* and hybrids of any of these species.

Techniques for stably incorporating DNA constructs into the genome of target plants are well known in the art and include *Agrobacterium tumefaciens* mediated introduction, electroporation, protoplast fusion, injection into reproductive organs, injection into immature embryos, high velocity projectile introduction and the like. The choice of technique will depend upon the target plant to be transformed. For example, dicotyledonous plants and certain monocots and gymnosperms may be transformed by Agrobacterium Ti plasmid technology, as described, for example by Bevan (*Nucleic Acids Res.* 12:8711–8721, 1984). Targets for the introduction of the DNA constructs of the present invention include tissues, such as leaf tissue, dissociated cells, protoplasts, seeds, embryos, meristematic regions; cotyledons, hypocotyls, and the like. The preferred method for transforming eucalyptus and pine is a biolistic method using pollen (see, for example, Aronen, in *Finnish Forest Res. Papers* 595:53, 1996) or easily regenerable embryonic tissues.

Once the cells are transformed, cells having the inventive DNA construct incorporated in their genome may be selected by means of a marker, such as the kanamycin resistance marker discussed above. Transgenic cells may then be cultured in an appropriate medium to regenerate whole plants, using techniques well known in the art. In the case of protoplasts, the cell wall is allowed to reform under appropriate osmotic conditions. In the case of seeds or embryos, an appropriate germination or callus initiation medium is employed. For explants, an appropriate regeneration medium is used. Regeneration of plants is well established for many species. For a review of regeneration of forest trees see Dunstan et al., "Somatic embryogenesis in woody plants," in Thorpe TA, ed., *In vitro embryogenesis of plants* (Current Plant Science and Biotechnology in Agriculture, 20[12]:471–540, 1995. Specific protocols for the regeneration of spruce are discussed by Roberts et al. ("Somatic embryogenesis of spruce," in Redenbaugh K, ed., *Synseed: applications of synthetic seed to crop improvement,* CRC Press: 23:427449, 1993). Transformed plants having the desired phenotype may be selected using techniques well known in the art. The resulting transformed plants may be reproduced sexually or asexually, using methods well known in the art, to give successive generations of transgenic plants.

As discussed above, the production of RNA in target cells can be controlled by choice of the promoter sequence, or by selecting the number of functional copies or the site of integration of the DNA sequences incorporated into the genome of the target host. A target organism may be transformed with more than one DNA construct of the present invention, thereby modulating the activity of more than one transcription factor, for example affecting gene expression in more than one tissue, or at more than one time in the development of the target organism. Similarly, a DNA construct may be assembled containing more than one open reading frame coding for a polypeptide of the present invention or more than one untranslated region of a gene coding for such a polypeptide. The polynucleotides of the present inventive may also be employed in combination with other known sequences encoding transcription factors.

Polynucleotide probes and primers complementary to and/or corresponding to SEQ ID NOS: 1–591, 1183–1912 and 1931–2106, and variants of those sequences, are also comprehended by the present invention. Such oligonucleotide probes and primers are substantially complementary to the polynucleotide of interest. As used herein, the term "oligonucleotide" refers to a relatively short segment of a polynucleotide sequence, generally comprising between 6 and 60 nucleotides, and comprehends both probes for use in hybridization assays and primers for use in the amplification of DNA by polymerase chain reaction. An oligonucleotide probe or primer is described as "corresponding to" a polynucleotide of the present invention, including one of the sequences set out as SEQ ID NOS: 1–591, 1183–1912 and 1931–2106, or a variant, if the oligonucleotide probe or primer, or its complement, is contained within one of the sequences set out as SEQ ID NOS: 1–591, 1183–1912 and 1931–2106, or a variant of one of the specified sequences.

Two single stranded sequences are said to be substantially complementary when the nucleotides of one strand, optimally aligned and compared, with the appropriate nucleotide insertions and/or deletions, pair with at least 80%, preferably at least 90% to 95%, and more preferably at least 98% to 100%, of the nucleotides of the other strand. Alternatively, substantial complementarity exists when a first DNA strand will selectively hybridize to a second DNA strand under stringent hybridization conditions. Stringent hybridization conditions for determining complementarity include salt conditions of less than about 1 M, more usually less than about 500 mM, and preferably less than about 200 mM. Hybridization temperatures can be as low as 5° C., but are generally greater than about 22° C., more preferably greater than about 30° C., and most preferably greater than about 37° C. Longer DNA fragments may require higher hybridization temperatures for specific hybridization. Since the stringency of hybridization may be affected by other factors such as probe composition, presence of organic solvents and extent of base mismatching, the combination of parameters is more important than the absolute measure of any one alone. The DNA from plants or samples or products containing plant material can be either genomic DNA or DNA derived by preparing cDNA from the RNA present in the sample.

In addition to DNA-DNA hybridization, DNA-RNA or RNA-RNA hybridization assays are also possible. In the first case, the mRNA from expressed genes would then be detected instead of genomic DNA or cDNA derived from mRNA of the sample. In the second case, RNA probes could be used. In addition, artificial analogs of DNA hybridizing specifically to target sequences could also be used.

In specific embodiments, the oligonucleotide probes and/or primers comprise at least about contiguous residues, more preferably at least about 10 contiguous residues, and most preferably at least about 20 contiguous residues complementary to a polynucleotide sequence of the present invention. Probes and primers of the present invention may be from about 8 to 100 base pairs in length or, preferably from about 10 to 50 base pairs in length or, more preferably from about 15 to 40 base pairs in length. The probes can be easily selected using procedures well known in the art, taking into account DNA-DNA hybridization stringencies, annealing and melting temperatures, and potential for formation of loops and other factors, which are well known in the art. Tools and software suitable for designing probes, and especially suitable for designing PCR primers, are available on the Internet, for example. A software program suitable for designing probes, and especially for designing PCR primers, is available from Premier Biosoft International, 3786 Corina Way, Palo Alto, Calif. 94303–4504. Preferred techniques for designing PCR primers are also disclosed in Dieffenbach and Dyksler, *PCR primer: a laboratory manual,* CSHL Press: Cold Spring Harbor N.Y. 1995.

A plurality of oligonucleotide probes or primers corresponding to a polynucleotide of the present invention may be provided in a kit form. Such kits generally comprise multiple DNA or oligonucleotide probes, each probe being specific for a polynucleotide sequence. Kits of the present invention may comprise one or more probes or primers corresponding to a polynucleotide of the present invention, including a polynucleotide sequence identified in SEQ ID NOS: 1–591, 1183–1912 and 1931–2106.

In one embodiment useful for high-throughput assays, the oligonucleotide probe kits of the present invention comprise multiple probes in an array format, wherein each probe is immobilized in a predefined, spatially addressable location on the surface of a solid substrate. Array formats which may be usefully employed in the present invention are disclosed, for example, in U.S. Pat. Nos. 5,412,087, 5,545,531, and PCT Publication No. WO 95/00530, the disclosures of which are hereby incorporated by reference.

The significance of high-throughput screening systems is apparent for applications such as plant breeding and quality control operations in which there is a need to identify large numbers of seed lots and plant seedlings, to examine samples or products for unwanted plant materials, to identify plants or samples or products containing plant material for quarantine purposes etc. or to ascertain the true origin of plants or samples or products containing plant material. Screening for the presence or absence of polynucleotides of the present invention used as identifiers for tagging plants is valuable for later detecting the amount of gene flow in plant breeding, introgression of genes via dispersed pollen, etc.

In this manner, oligonucleotide probe kits of the present invention may be employed to examine the presence/absence (or relative amounts in case of mixtures) of polynucleotides of the present invention in different samples or products containing different materials rapidly and in a cost-effective manner. Examples of plant species that may be examined using the present invention, include forestry species, such as pine and eucalyptus species, other tree species, agricultural plants including crop and forage plants, and horticultural plants.

Another aspect of the present invention involves collections of polynucleotides of the present invention. A collection of polynucleotides of the present invention, particularly the polynucleotides identified as SEQ ID NOS: 1–591, 1183–1912 and 1931–2106, and variants and x-mers thereof, may be recorded and/or stored on a storage medium and subsequently accessed for purposes of analysis, comparison, etc. Suitable storage media include magnetic media such as magnetic diskettes, magnetic tapes, CD-ROM storage media, optical storage media, and the like. Suitable storage media and methods for recording and storing information, as well as accessing information such as polynucleotide sequences recorded on such media, are well known in the art. The polynucleotide information stored on the storage medium is preferably computer-readable and may be used for analysis and comparison of the polynucleotide information.

Another aspect of the present invention thus involves storage medium on which are recorded a collection of the polynucleotides of the present invention, particularly a collection of the polynucleotides identified as SEQ ID NOS: 1–591, 1183–1912 and 1931–2106, and variants thereof, as well as x-mers of the polynucleotides of SEQ ID NOS: 1–591, 1183–1912 and 1931–2106, and extended sequences, probes and primers comprising or corresponding to a polynucleotide of SEQ ID NOS: 1–591, 1183–1912 and 1931–2106. According to one embodiment, the storage medium includes a collection of at least 20, preferably at least 50, more preferably at least 100, and most preferably at least 200 of the polynucleotides of the present invention, preferably the polynucleotides identified as SEQ ID NOS: 1–591, 1183–1912 and 1931–2106, or variants of such polynucleotides.

The following examples are offered by way of illustration and not by way of limitation.

EXAMPLE 1

Isolation and Characterization of cDNA Clones from *Eucalyptus grandis*

Nine *Eucalyptus grandis* cDNA expression libraries (prepared from either mature shoot buds, early wood phloem, floral tissue, leaf tissue (two independent libraries), feeder roots, structural roots, xylem or early wood xylem) were constructed and screened as follows.

Total RNA was extracted from the plant tissue using the protocol of Chang et al. (*Plant Molecular Biology Reporter* 11:113–116, 1993). mRNA was isolated from the total RNA preparation using either a Poly(A) Quik mRNA Isolation Kit (Stratagene, La Jolla, Calif.) or Dynal Beads Oligo $(dT)_{25}$ (Dynal, Skogen, Norway). A cDNA expression library was constructed from the purified mRNA by reverse transcriptase synthesis followed by insertion of the resulting cDNA clones in Lambda ZAP using a ZAP Express cDNA Synthesis Kit (Stratagene), according to the manufacturer's protocol. The resulting cDNAs were packaged using a Gigapack II Packaging Extract (Stratagene) using an aliquot (1–5 $\mu$l) from the 5 $\mu$l ligation reaction dependent upon the library. Mass excision of the library was done using XL1-Blue MRF' cells and XLOLR cells (Stratagene) with ExAssist helper phage (Stratagene). The excised phagemids were diluted with NZY broth (Gibco BRL, Gaithersburg, Md.) and plated out onto LB-kanamycin agar plates containing X-gal and isopropylthio-beta-galactoside (IPTG).

Of the colonies plated and picked for DNA miniprep, 99% contained an insert suitable for sequencing. Positive colonies were cultured in NZY broth with kanamycin and cDNA was purified by means of alkaline lysis and polyethylene glycol (PEG) precipitation. Agarose gel at 1% was used to screen sequencing templates for chromosomal contamination. Dye primer sequences were prepared using a Turbo Catalyst 800 machine (Perkin Elmer/Applied Biosystems Division, Foster City, Calif.) according to the manufacturer's protocol.

DNA sequence for positive clones was obtained using a Perkin Elmer/Applied Biosystems Division Prism 377 sequencer. cDNA clones were sequenced first from the 5' end and, in some cases, also from the 3' end. For some clones, internal sequence was obtained using either Exonuclease III deletion analysis, yielding a library of differentially sized subclones in pBK-CMV, or by direct sequencing using gene-specific primers designed to identified regions of the gene of interest.

The determined cDNA sequences were compared to known sequences in the EMBL database (up to mid-July 1999) using the computer algorithms FASTA and/or BLASTN. Multiple alignments of redundant sequences were used to build up reliable consensus sequences. The determined cDNA sequences are provided in SEQ ID NOS: 1–331, 1183–1536, 1896–1901, 1905, 1906, 1908–1910, 1932–1968, 2001–2036, 2074–2079 and 2104. Based on similarity to known sequences from other plant species, the isolated DNA sequences were identified as encoding transcription factors, as detailed in Table 1 above. The predicted amino acid sequences corresponding to the DNA sequences of SEQ ID NOS: 1–331, 1896–1901, 1905, 1906, 1908, 1909, 1910, 1932–1968, 2001–2036, 2074–2079 and 2104 are provided in SEQ ID NOS: 592–922, 1914–1919, 1923, 1924, 1926–1928, 2108–2142, 2175–2210, 2247–2252 and 2276, respectively.

EXAMPLE 2

Isolation and Characterization of cDNA Clones from *Pinus radiata*

Fourteen *Pinus radiata* cDNA expression libraries (prepared from either shoot bud tissue, suspension cultured cells, early wood phloem (two independent libraries), fascicle meristem tissue, male strobilus, root (unknown lineage), feeder roots, structural roots, female strobilus, cone primordia, female receptive cones and xylem (two independent libraries)) were constructed and screened as described above in Example 1.

DNA sequence for positive clones was obtained using forward and reverse primers on a Perkin Elmer/Applied Biosystems Division Prism 377 sequencer and the determined sequences were compared to known sequences in the database as described above.

Based on similarity to known sequences from other plant species, the isolated DNA sequences (SEQ ID NOS: 332–591, 1537–1894, 1895, 1902–1904, 1907, 1911, 1912, 1931, 1969–2000, 2037–2073, 2080–2103, 2105 and 2106) were identified as encoding transcription factors as detailed above in Table 1. The predicted amino acid sequences corresponding to the DNA sequences of SEQ ID NOS: 332–591, 1895, 1902–1904, 1907, 1911, 1912, 1931, 1969–2000, 2037–2073, 2080–2103, 2105 and 2106 are provided in SEQ ID NOS: 923–1182, 1913, 1920–1922, 1925, 1929–1930, 2107, 2143–2174, 2211–2246, 2253–2275, 2277 and 2278, respectively.

EXAMPLE 3

Use of a Myb Transcription Factor Gene to Modify Gene Expression in Plants

Transformation of tobacco plants with a *Eucalyptus grandis* Myb transcription factor gene is performed as follows. DNA constructs comprising sense and anti-sense constructs containing a DNA sequence including the coding region of the Myb transcription factor of SEQ ID NO: 2076 are constructed and inserted into *Agrobacterium tumefaciens* by direct transformation using published methods (see An G, Ebert P R, Mitra A, Ha S B, "Binary vectors," in Gelvin S B and Schilperoort R A, eds., *Plant Molecular Biology Manual*, Kluwer Academic Publishers: Dordrecht, 1988). The constructs of sense DNAs are made by direct cloning from PBK-CMV plasmid by cloning cDNA insert into pART7 plasmid, which is then cut by NotI enzyme and 35S-Insert-OCS 3' UTR put into pART27 plant expression vector (see Gleave, *Plant Molecular Biology* 20:1203–1207, 1992). The presence and integrity of the transgenic constructs are verified by restriction digestion and DNA sequencing.

Tobacco (*Nicotiana tabacum* cv. *Samsun*) leaf sections are transformed with the sense and anti-sense constructs using the method of Horsch et al. (*Science* 227:1229–1231, 1985). *Arabidopsis thaliana* (ecotype: Columbia) whole plants are transformed with the sense and anti-sense constructs using either the vacuum infiltration (Bechtold et al., *C. R. Acad.* 316:1194–1199, 1992), or floral dip (Clough and Bent, *The Plant Journal* 16:735–743, 1998) procedures. Transformed plants containing the appropriate construct are verified using Southern blot experiments. Expression of the Eucalyptus Myb transcription factor gene in transformed plants is confirmed by isolating total RNA from each independent transformed plant line created with the Myb transcription factor gene sense and anti-sense constructs. The RNA samples are analysed in Northern blot experiments to determine the level of expression of the transgene in each transformed line. The expression level of the Myb transcription factor, encoded by the Eucalyptus Myb transcription factor gene and by the endogenous Myb transcription factor gene, for each transformed plant line created with the sense and anti-sense constructs is compared to that of wild-type control plants.

SEQ ID NOS: 1–2368 are set out in the attached Sequence Listing. The codes for nucleotide and amino acid sequences used in the attached Sequence Listing, including the symbols "n" and "Xaa", conform to WIPO Standard ST.25 (1998), Appendix 2, Table 1.

Although the present invention has been described in some detail by way of illustration and example for purposes of clarity of understanding, changes and modifications can be carried out without departing from the scope of the invention which is intended to be limited only by the scope of the claims.

SEQUENCE LISTING (2368 sequences)

SEQ ID NO: 1 - DNA, 396 bp, Eucalyptus grandis
tctctctccgttcccctctctctctctctctctctctctctctagacaataagggggcattcaaagctctgtgctttccaccgaaaggactccagcagaaaggactcgtcgtcatgggcgagagagatgatctgggcttgagcttgagcctgagcttccctcagggtcacctgcatcagcagcagcagcagcagcagcagcagtccctgcagctgaacctcatgccctccttggtcccgtcctctgcttcgtctgctcaatctgggttcaatcttcagaagcgctcctgcaacgacgccttcccttcttcttcagatcggaactccgaggcgcgatcgttcctccgggggatcgacgtgaacagagagccgtcggcgggggcggcggcggactacg

SEQ ID NO: 2 - DNA, 725 bp, Eucalyptus grandis
ggacaaggcaaggttggtgcaggaaactggcttgcaattaaagcagataaacaactggtttatcaaccagaggaagagaaactggcacagtaacccgtccacctctactgtcctgaagagcaagcgcaaaaggtaattatattaagccagtgagtgaattaacttgattcttctagagcttctcaccaactaaaaattcaaaatgaagtaatgcaggtgaaaatagcagtgaccgcttcatgtagattaaggaaaattgtaaactaaactccttccgagtcgtgcatgtgctcatgatccagtggcacatatggttggtggcaaatgaagcgcgaatttcttttgattctgtagaggaagagcctaacatagatgagaaaaatctgcccactttctgctgctgtaaaggaaccacaaactaaattcggagggcagatccaaaacttatacccgcatcacgtggaagtcctggaataaagattgctgtctcgtaaattatgtgaaacgattctgctgcatcggctgatgggtgtaatttttgtttaccatattcatatatgtgaataagtacagagaagggttgtgggtgtatagtacaatagctctcgtttagttccatacacgtatagtagatagagattatagcatgttaggtgttgtcatttctactgtagtgtacgcttgtgaagcaaatgtagcttggtcttgattaacaaaaaaaaaaa

SEQ ID NO: 3 - DNA, 875 bp, Eucalyptus grandis
ctggagagccactttggatcaggagcgttgagaccggccgtgagatacttaactatgacgagtacgtgaaggagttcaaggtcgaagcccctagtgagggccggcccaagagatctatcgaagcctcgagagagactggggtcgtgttcgtcgacctcccccgcctcgtgcaaagtttcatggacgtgaatcaatggaaggaaatgtttccttgcatgatctcaaaggcagcaactgtggatgtggtttgcagcggtgaaggtcccaacagaaacggcgccgtgcaattgatgttcgcagagctgcaaatgctaacgccaatggtgcccacgagggaggtgtacttcatcagatactgcaagcagctcagcgcagagcagtgggccttagttgatgtctccatcgaaaaagtcgaagataacatcgacgcctctcttgtgaaatgcaggaaacgcccctccggctgcatcatcgaggataaatccaacggccattgtaaggtaatctgggtagaacacttggagtgccagaaaaccaccgttcatcccatgtaccgtaccatcgttaacagcggcctagcctttggcgcaagacactggatgacgacactgcaagtccagtgcgagcggctcgttttctttatggcgactaatgttccaaccaaagattcgaatggtgtcgccacacttgcaggaaggaagagcattttgaggctggcacagaggctgacacaaagcttttgtcaggccattggagcatcgagctatcacagctggaccaaggtcccaactaaaactggagaggacattagggtggcttctaggaaaaatctgaatgatcctggagagcctcttggggtgatcctatgcgcagtt

SEQ ID NO: 4 - DNA, 78 bp, Eucalyptus grandis
aatgcaggcggtgatgaccggctgtgactctagcaacatagccgctctgccatccggtttctcgatcctgcccgatgg

SEQ ID NO: 5 - DNA, 791 bp, Eucalyptus grandis
acaaaatggtccaagcatgcctccagtacagccttttgtccgagcagagatgctccctagtggctacttggtacgtccatgtgaaggtggtggttcaatcatacgcattgttgatcacttggatctagagccatggagtgtgcctgaagtactgcgaccattgtatgagtcctccacaatgcttgctcagaagacgacaatggcagctctgcgacagctgaggcagatagctcaggaagtttcacagcctaatgtttctggctggggaaggcgacctgcagcacttagagctcttagccagaggttaagcaggggatttaatgaggctcttaatggatttactgatgaaggatggtcgatcatggggaatgatggcattgatgatgtcactattctcgtgaattcatcccctgacaagctaatgggattgaatctttcgttttcaaatggattcccagctgtgagcaacgctgttctatgcgcgagggcctctatgctcttgcagaatgtgcctcctgcagtcctccttcgcttccttcgtgagcacaggtcagaatgggctgacaacagtattgatgcatactcagccgcagcagttaaagttggttcctgtgctttacctggatcacgtattgggagtttcgggggtcaggttatacttccacttgctcatactattgagcatgaagagttcttggaggtcatcaaattagaaggtatgggccactctccagaagatgccttaatgcctagagatatatttttcctgcaaatgtgcagtggagtggatg

SEQ ID NO: 6 - DNA, 403 bp, Eucalyptus grandis
gtgccctatcgattcgggccgctccttcgacacgagccttagtctcggtttaggctgttatggggatcctgaagatcacgagatcaagatcaagaaaccgctcgcgaagctcagtggtaactccacgtgcctcacgataggcttgcccggcggggaggcgtgcgggctgggatccgcgagtggggacgaggtcaggaacatcccgagcaggtcggcatcgtcgttctcaaactcaagcagtgcgaagagggagaaggcggagcaaggagaggaagaagcggttgagagagggacgggctcgccgagggcgactatcaatatcgaagatgaagatgagttcagccccaggaagaagctcaggctttctaaagcacaaagttccattttggaagagatgcttcaa

SEQ ID NO: 7 - DNA, 955 bp, Eucalyptus grandis
gaaaattcaatacgctaccttgcttcgaccgaagtcctctccctctctctctctctagacatattcaaatccgattctctctctagcctccccgtcgccgctgtcgtcgccggtcgccgtcgccgtcgcagagccgcggaggaggagagggagagagagagagagagcggagagacgccggtgcggggatggggcagcagtcgctgatctacagcttcgtggcgcgggggacggtgatcctggcggactacacggagttcaccggcaacttcaccagcgtcgccttccagtgcctccagaagctccccgccaccaacaacaagttcacctacagctgcgacggccacaccttcaacttcctcgtcgacgacggcttcacatactgtgtggtggccgttgaatctgtcggtcggcaagttccaattgctttccttgagcgagtcaaggatgattttacaaagagatatggcggtggaaaagctgcaactgcagttgccaaaagcctaaacaaggaatttgggtccaaattgaaggagcagatgcagtactgtgtggatcatccagaggagatcagcaagcttgctaaagtaaaagcccaggtttcagaagtaaaaggagttatgatggaaaatatcgagaaagttcttgatcgtggagagaaaattgagcttctggtcgacaaaactgagaacctccgatcccaggcacaagatttcaggcagcagggtactcagatcagaaggaagatgtggctgcagaacatgaagatcaagctgatcgtactcggcattttgatcgctttgattctcatcatcgtcttatccatttgtggcaatggcaaatgtaaataaattttggagctttggagagattgcattaatttcaagtcacacacactatggacgcgtgttctatatgacagtatttaattgctgtgtaaaaaaaaaaaaaaaaa

SEQ ID NO: 8 - DNA, 666 bp, Eucalyptus grandis
gaagagaaaaaagaggagcctccggctccaataacagtcgtgttgaaggttggaatgcattgcgaagcatgcactcgagttttgcggaaacgaatccggaaaattaaaggagtagagacagtggagaccgacgtggtgaatgaccgggtaatagtcaaaggtgtggtcgacccgccgaagctggtcgcatacgtgaaaaagagaacggggaagcaagcgtcgattgtgaaggaagaggagaagaaggaagaggagaagaaggaagaggcgaagaaggaggaaagcaaagaaggagagaagaaggacggcgaggaagggaaggacgaggacggctcgaagatggacataaagaagaacgagtactggccctccaggccttacatggaatatcaaatgtacccaacccagatcttcagcgatgagaacccgaacgcttgctccgtgatgtagtgtgatgtagtgctgagagtttccaacctcggccccagttaagagtacgtgtcgaggcaattttccattgtacttaaagattgctaataaacagattcgcgagaccgggagtcgttggctaattgtaatccgttgatgttctgtaatctgtgttaccaattgtctactctcttaatgtgaaagtgtagatgaattttcagtaaaaaaaaaaaaaaa

SEQ ID NO: 9 - DNA, 352 bp, Eucalyptus grandis
cctcgtccccaaggtttttttgcggcagtatggagttcccgagtgaattttcagaggcctcttcacagaagagaatcggggggagagggaaaatagagatcaaacggatcgagaacacgacgaaccggcaggtcaccttttgtaaacgccggaacgggttgttgaagaaggcttatgagctatcggtgttgtgcgatgctgaagtggcgcttattgtcttctcgagccgtggcaggctctatgaatatgctaacaacagtgtcagaggaacaattgagaggtacaagaaagcaagcagtgattcctcacatccacagtccgtttctgaagtgaacactcagttttatccagc

SEQ ID NO: 10 - DNA, 989 bp, Eucalyptus grandis
gaggagatggcgagggggaagatccagatcaagctgatagagaacacgacgaaccggcaggtgacctactcgaagcgacggaacgggctcttcaagaaggcgaacgagctcaccgtcctaggcgaccccaaggtctccatcatcatgatctccagcaccggcaagctccacgagtacatcagcccctccacctcaacgaagaagatgtacgatcagtatcagcaggcgctcgaggttgatctctggagctctcactatgagaagatgcaagagaacctgaggaagctgaaggaggtgaacaagaagcttcagctggaggtcaggaggaggttcggggaaggactgaatggtatgagcttatcggaattgtgcggtcttgagcaagatatggacaacgccgttagcctgatccgtgaacggaagtacaagacgctcggcaatcaaatcgacaccgccaggaagaagaaaaagaatgctgaggaaataaacaaaagtctcctgcaagactggaccaatctgatcaagcatctgagggaggacgacccgcacttcggaatggtcgacaacggcagggattacgaggctgtgatcgggtatacagacgccgccgccgccgctcgcttgtacaccctgcgcctgcaaccggaccagcccaatcttactagcggaggaggatcggagatcacgacctaccctttgctcgagtgagacgaaggcgtcggaaacccttccgacgtcctcatattgtctattcattctgtctaagggccgattccatctggaatcctgacttcattggtatgtcgaagtttaggactttgttatgtcatcctattcagcagctaagtttgttcttatcagaagctgttcctattatggaccgagggcgatttcctctagggcatcatgtgttttaagacaagtctatatataagactactttaaaacaatcgaatgagttggtgcaaaaaaaaaaaaaaaaaaaaaaa

SEQ ID NO: 11 - DNA, 526 bp, Eucalyptus grandis
agaaaatacagaaatctcagcacgatccccatctcctccttcgccaaagtcgttgggaacttccccccttctccctctcgctccgtccacgaagcaagcaagctctccgcgaagatcccttccttgttgttaccaaattggttgaagcttcttgtgggttgctggacctgcagattttggttaataaatgagtcagaagggccttatatatagctttgtggcgaaagggactgttgttctggccgagcacacgcaattttcgggaaactttagtactattgctgtgcagtgcttgcagaagctgccttctaatagcagcaagtacacatactcctgcgatgggcacacatttaacttcctaacggatagtggatttgttttcctggttgttgctgatgagtccgtcggaagaagtgtgcctttcgtgtttcttgagcgagtgaaggatgactttatgcagcattatagtgccagcattgcaagtggcgacccacatccacttgcagatgatgatgaggatgacgat

SEQ ID NO: 12 - DNA, 342 bp, Eucalyptus grandis
agagagtaatggggagagggagagtggagctgaagaggatagagaacaagatcaacaggcaggtgaccttctcaaagaggaggaatgggctgttgaagaaggcctatgagctctctgtgctgtgtgatgttgaggtcgcgctcctcatcttctccagccgtggcaagctctatgagtttggcagcgctggcccttctggcataaataagacgcttgaacgataccaacgtgacaacttcactcctcaagacaacgttgctgaacatgagacacaacagaactggtttcaagagatatcaaaattgaaggcaaaatatgaactcttcaacaaactccagaagc

SEQ ID NO: 13 - DNA, 197 bp, Eucalyptus grandis
gcctgcttcaaaaatcatctcaggaggaagacaaagcaaggctagtacaagacacgggcttgcaattgacacagattaataattggtttataaaccaacggaaaagaaattggcacagcaacccttcgtcttccacagttcccaagagcaaacgcaagagaagccatgcaggtgatccggataaagagagacctatg

SEQ ID NO: 14 - DNA, 182 bp, Eucalyptus grandis
tgtatagaaacaaaagcacgatttggaaaatcggttgaatctccggccacggacaagtggaaagtgtggttccagaataggagagccaggactaaattaaaacaaactgccgtagagtgcgagatgctgcagaaatgctgcgaaaccctaaaagaagcgcacagcaggttgcagaaggagtt

SEQ ID NO: 15 - DNA, 983 bp, Eucalyptus grandis
ggcttccctttcttatcctccattctcctctctccttctccttacactcacagacacaatcacagagagagagagagagagagagagagagagagagagagaatggcattcgcaggaacaacccagaagtgcatggcctgtgagaagacagtctatctggtggacaagctcacagctgacaatagaatctaccacaaggcctgcttcagatgccaccattgcaaagggactctcaagcttgggaactataattcatttgaaggagtcttgtactgccggccgcatttcgatcagctcttcaagagaactggcagcctcgaaaaaagctttgaaggaacccccaagattgcaaagccagagaaacccgtcgatggagagagacctgcagcgaccaaagcctccagtatgttcgggggaacgcgagacaaatgtgtaggctgtaagagcaccgtctacccgaccgaaaaggtgacggttaatgggactccataccacaagagctgcttcaaatgcacccacggggggtgcgtgatcagcccatccaactacgtcgcgcacgaggggaaactctactgcaggcaccaccacactcagctcataaaggagaagggcaatctcagccaactcgagggcgatcatgagagggaaacaatggctcctgaatcataaaacgctttgatcttgcactaccttgttcgttgagctgtcaccacactttgtggccagcggatttcaggctggtccaaaaacctgttatgctattagagaatctatgtccatctactaaatttgagatgtgtgagccttgaccggtttgatttggcttctgttttgcgattgcggatgatttctcgggttggttgtaagcgtagaataagtggtgcttgcttcttgactttgtgaaacctctgagcttgctttcttttcagtcttgtccagcgagtgtgtctagcatcatccctatttttcaaaaaaaaaaaaaa

SEQ ID NO: 16 - DNA, 397 bp, Eucalyptus grandis
catttggtaagatatttgaagagtcagtccgcaaagaattgtcccccgagtttgccaagttaatgcaagaggggtctgcctacttgccctctggaatttgcatgtcgacgatggggcgacatgtctcatatgaacaagcgatcgcgtggaaggtcctttctgcggaggagaacactgtccactgcctcgcttctctttcgtgaattggtctttcgtgtgagcatagcctaatatattctttttttgacgccctcttgctgctgttgaatagatgtgaaaaaactaagaggggttaggagttttgtcatactgaaaaagaaaagaaagaacacatccaattccccaattttttatttaatgaaaatttccatgtgatgtgcaaaaaaaaaaaaaaaaa

SEQ ID NO: 17 - DNA, 60 bp, Eucalyptus grandis
atgatggaaatattgagaaggttcttgatcgtggtgaaaaaatcgaacttctggttgata

SEQ ID NO: 18 - DNA, 60 bp, Eucalyptus grandis
agacagtcaatcttcgttctcaggctcaagacttcaggcagcagggacccaaaatgcgac

SEQ ID NO: 19 - DNA, 60 bp, Eucalyptus grandis
gaaaaatgtggctgcagaacatgaaaatagaagctgacttagttctgggcattattattg

SEQ ID NO: 20 - DNA, 48 bp, Eucalyptus grandis
ctttgattctggtcattgtttatctgttttgtcatggcttcaattgtg

SEQ ID NO: 21 - DNA, 766 bp, Eucalyptus grandis
tctgcagcatcattaaaagctagtccatttggctatcctggtatgaggcccacaagattcaccgggagtcaaatcatcatgccccttggtcacacaattgagcacgaagagatgcttgaagttatccgtcttgaaggccattctcttgctcaagaagatgcttttgtatcaagagatattcatcttttgcagatatgcagcgggatagacgagaatgcagttggagtctgttccgaacttatttttgcgccaattgatgaaatgtttcctgatgatgctccactgctaccctctggtttccgtatcataccactggattcaaaatcatctgatgtacaggattctctaacgacaaatcggacccttgatctgacatcgagtcttgaggtggggcctgcatcaacaaattgcgttggagatgttgcgccaagccatggtgcacgatctgttctgactatcgccttccagttcccatttgatgccaacacacaggataatgtggcagtcatggccaggcaatatgtccgtagcgttatttcgtctgtgcagcgggttgcgatggtcatatctccatcaggattgggcccttccattaaccccaagctttcacagggatctccagaagctctaacacttgctaactggatctgccagagctacaggcatgttctgataatttgattgaattggtcttcttttggtgcatctcactctgtgtttgttgtgatctgccactcatcaagctgatgctcgactatctctctcc

SEQ ID NO: 22 - DNA, 329 bp, Eucalyptus grandis
atacacaaggagatccacaagtctgggggaatagcacaagaggttgcagctgctgggccttcgtcttcttctggtggcatgaagagatcactggtcttctttttctgcgccaattgatgaaatgtttcctgatgatgctccactgctaccctctggtttccgtatcataccactggattcaaaatcatctgatgtacaggattctctaacgacaaatcggacccttgatctgacatcgagtcttgaggtggggcctgcatcaacaaattgcgttggagatgttgcgccaagccatggtgcacgatctgttctgactatcgccttccagt

SEQ ID NO: 23 - DNA, 954 bp, Eucalyptus grandis
attggaccttgcctcttctcttgagatcgggccagctggaaataggagttttaatgatattaatgctaattctggttgtacgagatcagtgatgactatcgcatttgagtttgcattcgaaagccacatgcaggaacatgtggcctctatggcccgccaatatgtgcgtagtataatatcctcggtgcagagagtggcattggcactctctccttccaatctcggttcacatgctggtctgcgtacacctcttggcactcctgaagcccaaacacttgctcgctggatttgccacagttataggtgctacttgggggtggatcttctcaagtccagcaatgaaggaagtgagttgattctcaagaacctgtggcatcactcagatgctattatgtgctgctctcttaaggccttacccgtattcacgtttgcaaatcaggcaggtctggacatgctcgaaaccaccttggtggcgctgcaagacataaccctggaaaagatttttgatgatcatggccgaaagactctgtgttcagagttcccacaaatcatgcaacagggttttgcttgtcttcaaggtgggatctgcctctcgagcatgggacgaccagtgtcatacgaaagggcagtggcgtggaaagttatgaatgaggaagagaatgcccactgcatctgctttatgttcatcaactggtcttttgtgtgatttctgttgcagaaactaaggtattaagctatgtaagttgtgaagaatgactcttcatctagtgactgctacttcaaactcctatggtctgtgaaccttagaactgatgtgtcctctcttgtttagacgttcgtcatgtggacgcctggtcgatgtcgactcttttgccatgtctgtgtagtggttatgaatggacgtggatgttatgcttggaagtggttgattatcattttcgtgctgtagatgtg

SEQ ID NO: 24 - DNA, 338 bp, Eucalyptus grandis
cagagagagagagagagagagagagagagagagagaatggcatttgcaggaacaacccagaagtgcatggcctgtgagaagacagtctatctggtggacaagctcacagctgacaatagaatctaccacaaggcctgcttcagatgccaccattgcaaagggactctcaagcttgggaactataattcatttgaaggagtcttgtactgccggccgcatttcgatcagctcttcaagagaactggcagcctcgaaaaaagctttgaagggaacccccaagatttgcaaagcccagagaaacccgtcgtggagagagaccttcagcgaccaaaggcttc

SEQ ID NO: 25 - DNA, 338 bp, Eucalyptus grandis
gcggcaaggagcaactaaatgtaacactctgattactagggacctctcattgtctttggatggcatttaaatcaccaggaggaatcacgtggctgaaacatttacttgtgaagaacttttacttaggggagcatctaaaatgcaggaatgggctcatcaagaaggcctacgagctctccgtcctctgcgacatcgacatcgccctcatcatgttctccccctccgaccgcgtgagccacttttcgggaaaaagaaggatcgaggatgtcttgacccgtttcattaacctcaccgaccaagaacgagacactcctagatgtccaggatcggcgcacacg

SEQ ID NO: 26 - DNA, 301 bp, Eucalyptus grandis
caaaccttcccagggtttccatttccatttccttcatagaatgctccgttcctttcttatccctttttgggtactctctgttctcatggtcctttcataaagttttctcatctcttaaccaagactggtaagagagagagagatagagagtttattagtgggtgagggtgttaaaaaatgggaagagggagggttcagctgaagaggatagagaacaaaattaacaggcaagtgaccttttccaagagaaggaatgggctcctcaagaaggcttatgagctctcgctcctctgtgatgctg

SEQ ID NO: 27 - DNA, 188 bp, Eucalyptus grandis
cgagatctccgtcctctgcgacgccgacgtcgccctcatcgtcttctccaccaagggcaagctcttcgagtacgccaccgactgttgcatggagaggatcctcgagcgttatgagagatattcatatgcagagagccaggttctcacaaacaatgccgaaaccaatgggaactggactttggaacatg

SEQ ID NO: 28 - DNA, 261 bp, Eucalyptus grandis
gtgattcctcacatccacagtccgtttctgaagtgaacactcagttttatcagcaagaagcatccaagcttcggagacagataagagaaatccaggtctcagataggcatcttctaggtgagggtataagtgatttgagcttcaaggatctcaagaatctcgagagcaaattagagaaatcgatcagccgtgttagatcaaagaagaatgagatgctttttgccgagattgagtacatgcagatgaggggccttgtgcagg

SEQ ID NO: 29 - DNA, 298 bp, Eucalyptus grandis
gagaactctcgcaatgagtgggatatactttcaaatgggggacaagttcaagaaatggcacacatagcaaatggtcgcgaccctggcaacagcgtctcgttactccgcgtaaataatgcaaattcgagccagagcaacatgcttatactgcaagaaagctgcacagactctgttggtgcttatgtgatctatgctccagttgacattgtcgctatgaatgtcgtattaaatggtggcgaccccgactatgtagcgctgttaccctcaggttttgccatacttcctgatgggccagagt

SEQ ID NO: 30 - DNA, 218 bp, Eucalyptus grandis
cgaccgagcaggtccatttcctcgagaagaacttcgagctggagaacaagctcgagccggagaggaagatccagctcgccaaggacctcggtttgcagccccggcaagtcgcgatatggttccagaaccgccgggcccgatggaagaccaagcacttggagaaggaatacgaagatctgcaagccagctataacagcctcaaggccgactgcgacggc

SEQ ID NO: 31 - DNA, 240 bp, Eucalyptus grandis
aaacaggcaggtgaccttcgctaagaggaggaatgggctgctcaagaaggcctatgagctctctgtcctctgcgatgctgaggtcgccctcattatcttctccacccgcggcaagctctatgagttctgcagcagccctagcatgctcaaaacgctcgaccgttaccaaaagtgcagctatggatccgttgaagttaacaaaccctccaaagaactagagaatgcctaccgggagtactt

SEQ ID NO: 32 - DNA, 1223 bp, Eucalyptus grandis
ggcccctctctctttctctctctctgtgtctgtctttcttgtggatccaccaggctcgtctttaagaatatacagcagcgagcaggcaagacaacgccccatctctcttctctctctctctctctctgtggctctgtctttcttttgtttcttgccgttttggggtgtgtgtgttgggttgtgtgaattggagcgaggatggggagggggagactgcagctgaagaggatagagaacaagatcaaccggcaagtcaccttctccaagaggagggcgggtctgctcaagaaggcccacgagatctccgtactctgcgacgccgaggtcgccctcatcatcttctccgccaagggcaagctcttcgagtactccaccgattcctgcatggagagaattctcgaacgctatgaaagatactcatattcggagcaccaagttcttgcaagtgagacagaatcgattggtagctggactttggagcatgctaagctcaaggccagacttgaagttttacacagaaattataggcatttcatgggagaagatcttgattctttgagtctcaaggacctccaaaatttggagcagcaactggagtctgctcttaaacacataagatcgagaaagaatcagctcatgcatgaatcaatctcagtgcttcagaaaaaggatagggcattgcaggagcaaaacaacctgcttacaaggaaagtaaaggagaaggagagggcactagcgcagcaagctcagtgggagcagcaagaccatgcccttgactcacctgttgttctaccccactacttgccatctctcgacatcaatggctcttatcaagcgagacacaacggacacgatgacggagagaacctgactcagcctcgggctggtacacttcttcctccgtggatgctccaccgtctcaattaaggcttcgacataaagggaaacttctgctgctatatctttgatatgcaattctgaagtccagctgatgaattgcatggcataatctggggctctcccccacccttgttctagcgaaataaacatacctctgctttttgctgcattcagtactcctaagtgtggtcctccgtgtatgtatagcaccattgcaaatatgcataccaatgtacatgtatgcaaaattatatatggaagttaacacaaccataaagcagatggagaagtatattgtttgctagcaaaaaaaaaaaaaaaaa

SEQ ID NO: 33 - DNA, 2148 bp, Eucalyptus grandis
ccgatctctcccaatcccctcctctcactctcccccaaaaaccagtctctggttttcctctctcccctgcacacacacacattctctctcctccttcccaccattattacagaaacagcagactgcgtagtgttgaaaaacttgatccacaattgattgggtaatgatgatgatctagagggagagagagagagagagagagagagagagagagagagagagagagcataaattcagtgcaagcttttgattggtgattggtgacatctcttctgggttgggtttgggtttgtgggtttgggtttgggttggtcttttgcttgtgagagtattattctttcttcaccctctgtgcatgaattttcttgggccatgctcatgcattctcctcctctttcttcatcaccatcgtcatcgtctctggctttgatgggttggcgagggggggagctgagggagagggagaggagaggagagaggagcggctgtgcgttcgcgtgcagggctgcacgaggtgttctcgtttcgggcgcgggcgctctgcttccatggctgcttttaagtaagacgccaaaagaaaacctttttgctctctcgagtgtcatgaactcgcactgaaagtgcgcgccgaaccgagaagaagaagaagaagaagaagaagaagaaagagaaaccatccccttagaaaacgcgaaaaagagtaaatagtaaaaagagcaagcttgatcttacttgatctaaaacattaagatccttctctgttcgagagaagtcacagtcccgctttttccagacatgaagagacttggcagctcagattcgttgggtgctttgatgtccatctgcccaccttcagaggaattgcagcacagtccgagaaacggcaaccccatctaccacagcagggacctgcagtccatgctggagctgggcctcgacgaggaaggctgcgtggaggaccagtccgccggcggcggggggcacgtcggcggcgagaagaagcggcggctgagcatcgaccaggtcaaggccctggagaagaacttcgaggtggagaacaagctcgagccggagcggaaggtgaagctggcccaggagctggggctgcagccgcgccaggtggccgtgtggttccagaaccgccgcgcgcggtggaagacgaagcagctggagcgggactacggcgtgctcaagtccagctacgaggcgctcaagctcagctacgacgccctcaagcacgacaacgaggcccttcacaaggagataaaagagctgaaatcgaaactccgggaagaagacgacaaccccgagagcaatctctccgtcaaagaagaggtcatcatccccggccacgacgtgtcggacaagatccgggccgcagacgacggtgacgacgacaccaaacgctctcctccccctccgatcaccgccccgcctcgcgagctgagcttcaacaatggtgggctgaaggacgggtcgtccgacagtgactcgagtgcaattgtgaacgaagagaacgcggcgaccagcagcagcagcccgaaccccgccgtccagagccacggcggcttcttgaaattcatggggtcatcgtcctcttcggcctccccaccgccgccgccaccggcttccttcggcgggtgcttcagcttccagttccagcgagcgtaccagcctcagcctcagcctcctcaccaccaccaccaccacagtccgtacgtgaagatggaggagcacaatttcctcggcggcgaggaggactgcaacttcttctcccaacaacaagcccccaacccgcaatgggaacgcccccaacaagggaaacgaaggaaaacaaactccccccgtggaaggggactccagattagagatcgataaaaaaaatgtagggcgacaactccctagctttacgtgcttgtgaagtgaaacaaactctcgggcacacgattgcacgaatcacttcaacccggcacgacatgactcgacacgacgagaataagatcgagctagtgagagaagagtttgggcacggagcgacaattcgagtagtatgcagttccttattgcgcgcggcattccggttataggatgcaaattagaattgaatatgatgcgatatggtaatgttttaaaaaaaaaaaaaaaaaa

SEQ ID NO: 34 - DNA, 273 bp, Eucalyptus grandis
gtcttgcgctcggttcttgagctcgttcttgagagctgaacggagacgatgggcgaggaatcgttcatatacagcttcgtggcgagagggacgatgatcttggccgagtacacggagttcacgggcaacttcccggccatagccgctcagtgcctccagaaactcccttcctccaacaacaagttcacctactcctgcgatcaccacaccttcaatttcctcctcgaagatggctacgcttattgtgttgtcgccaaagaatcagtgggccaa

SEQ ID NO: 35 - DNA, 384 bp, Eucalyptus grandis
attccatttagcctctttcctcctcaatcggaagggttcttcaacccaatggacggcaacctctcattgcaaatcggatacaatccgacatgtctggacgagatgaatgcttcggtttcgagccaaaatgttgccggattcattccgggatggatgctttgaacttactacatcgacttggagtgtgaatcgagctggtgaaatttgtgcgcgtgtcccttgtaaaattgcgatccgcaagacaataagtacataatattttggagctgtgatgacataaaaagaggaaggccaccctttcctctctcatgatcagaacttttgataatgtctgtatggcccggcagtgcaattggaacgagctcagctttgcagttcttttcg

SEQ ID NO: 36 - DNA, 238 bp, Eucalyptus grandis
gcaggaggagagcccatgtggattgcaggacccgatggctcttcaagcgtgctgaatgaagacgagtacattcgcgcatttcctcgtgggatcgtaacaaaccccaccggatttaagcgcgaacctcacgacaaaccggggtcatcatcatgaatcacatcaatcttgttgagattctcatggatgtgaaccagtggtccactatattctcaagcatcgtgtcaagagctatgacttt

SEQ ID NO: 37 - DNA, 698 bp, Eucalyptus grandis
gccttggcacgcagattccatcgggaatccatatgccttctgcgaatcttagttccatatcgttcttgggtcctattcccatggtatcgggggatggtggtgggaggaccggttctgagcggtcaagaaacgctgattgtgctccggcaggttttcctggaggtgatgaagatgtgaataagggaggggacattccttatggaatgtcaaccatcgtgagagtcattcccaattctaggtacttgagggtggcgcagcaactgcttgatgaaatagtgaatgtgcgaaaggctttgaagcgctctgatgacgcgaatgaccaatctagacatgagaaccaaaggagccccaaagatgcggatgggggttccaagaacgaagcatcctcaaatccccaagaatccgccagtaactctagcgagctttctgctgctgaaaaacaagatttgcagaacaagctcacgaagctcttgtccatgttggacgaggttgataaaaggtacaagcagtactatcaccaaatgcagatcgtggtacagtcttttgatacaatagcaggaagcggtgcagccaagccctacacggcgcttgcgctccagaggatatcccgccacttccggtgcctgcatgacgcgatcacgggtcaaattcaagcaacccgtaaaagtctcggagagcaagacacctctacagaaacg

SEQ ID NO: 38 - DNA, 277 bp, Eucalyptus grandis
aattcttactgacactccatcaaactggtacaccgcgtcctgaacatttcacccagtggacctcaatgacttgatatcttagaatggatattggaacttataggggttacgtacagacgtcttgatggaagtacccaggtgacggacagacaaagcatagttgacactttcaataatgatacttccatatttgcttgcttgctttcgacgagagctggaggacagggtttgaatttgaccggagctgacacggttgtcatccatgacatgggatttc

SEQ ID NO: 39 - DNA, 225 bp, Eucalyptus grandis
tgttggcaccatgtacacacacagtgtggtaaagcaggctttgggatgctcaagcaagagaatctgagcaatgaactagatagggtcaaaaaggagaacgacaacttgcagattcagctcaggcacctgagaggaagacataacatcactgaaccacagagagctgataatcctagaagacactcttgaaaacggcctcggatgtgtccgagaccagaaggacga

SEQ ID NO: 40 - DNA, 341 bp, Eucalyptus grandis
aggcagcaaagagctcgagtccttggaaagacagctagatgggtcattgaagcagatcagatcacgaagaactcagtacatgttagatcagctgactgatcttcaacatcgggaacagttgctccacgaagcaaacaggaccttgaatcaacggttgatggaaggataccaagtgaatgcgctccagttaaatcaacatgccgaggaagtcggaggatacggtcatccaccgccgccgccactgccgccacagccacttgctcagcctcacagcgaagcttttttcatcccttggaatgtgaacccactttgcaaatgggataccagcccgatccagtgtc

SEQ ID NO: 41 - DNA, 1286 bp, Eucalyptus grandis
ccatcaagctttctttcacaaagagaggggctttcgggagacaagcttcgacggagaagagtctttaacttagcaccaatatagagagcgtcttcaagctcgggtatggtcgagggagaaagaaatggcgatgacgatggtgcctcacagggagagcagcagtggaagcatcaacaagcacttgaccgactcggcaagtacgtgaggtacacagcggagcaagtggaagctctcgagagggtctattcagaatgccctaagcccagctctctgcgcagacaacagctgattcgggagtgtcccattttgtccaacatcgagcctaagcagatcaaagtctggtttcagaatcgcaggtgtcgagagaagcagagaaaagaggcctcaagactccagacggtgaacaggaaactgacggccatgaacaagctcttgatggaggagaatgatcggctgcagaagcaggtttcgcaattggtatgcgaaaatggctacatgcgtcagcaactccatactacatcggctactactaccgatgcaagctgcgactctgtggttactactcctcagcactctctcagagatgcaaataaccctgctgggctcctctccattgcggaggagacattggcggagttcctctccaaggctacaggaactgctgtcgattgggttcaaatgcctgggatgaagcctggtccggattcggttggaatcttcgccatttcacaaagttgcagtggagtggccgctcgagcctgtggtcttgttagtttagaaccaaccaagattgtagagatcctcaaagatcgtacttcatggttccgggactgtcggagccttgaagtcttcaccatgtttcctgccggaaatggtggaacaatcgaacttgtttacacgcagatttatgctccaactactctggctcctgcacgagatttatggactctcagatataccacgactctagaaaatggcagtcttgtggtatgtgagagatctctgtccggatctggtgccggccccaacccagcttcagcagctcaatttgtgagagctgaaattcttcctagtggctatttgattcgcccatgcgagggtggaggatcaatcattcacattgttgaccacctcaatctcgaggcctggagtgttcctgaggttcttcggccactttatgaatcatccaaagttgtggcccagagaattactattgcggctcttcgatacatccggcaaattgctcaggagacgagtggggaggtggtttatggtttgggaaggca

SEQ ID NO: 42 - DNA, 338 bp, Eucalyptus grandis
ctctcttctttctctcttttctctcaagctctctccttcatcttcaagaacacaagaccaaatcaatctcccaccatctcctcaaatgggcatagatgatctgtgcaacacaggccttgttctgagtcttggcctcgagacgcccttcaagatcgaagcccagaggcaagccaaacagcgccttaacttcgagccctctcttacgctgtgcctctccggcacgaccaaagctacccgcgacgagcagcctccggcggaccacttgtatcgccaggcttcgccgcacagccacaacagcctcagcgcggtgtcgtcgttctcgagtccgcgggtgaaga

SEQ ID NO: 43 - DNA, 219 bp, Eucalyptus grandis
ggagagtggtgaagcacggcgacttagagattctctggtggaaatggcaaatgtaggcaagagccctagcatgttgacagagtgtggtcttgcagagaattctctcgtctcaattgcggaaagagtgacacatcatcggtggtcctggtcggaggtcaaatatctctctgattgccatctgatggcactagatgctagcctttagagttgtgtatcgga

SEQ ID NO: 44 - DNA, 310 bp, Eucalyptus grandis
tattctgaagcaagttcagatgagggaaatcagtattctacacgtgaagaggagggagagattgaggagtttgaggaggacacttacagtggtgctcctggagcactaccaatcaacaaagaccagtctgatgaggatgttccggctgaagaatgtgatgagtatccatggacatcagagaggactaggaacaatcatttgccggaagaagccggtttctcaggatcatcggcagacagtcctagaggaatcaggatggcatctccttctgcttcttcacagaaatttggatctttgtctgcattagatt

SEQ ID NO: 45 - DNA, 1043 bp, Eucalyptus grandis
tctctatctctgttctcgaacctctgcggcgaattccttctctctataactgaagagtatgaacgcgccataagcgtcgtcgtcttcgtcgtcatcgtcatcatcaacgggattcctcccatcgcccctcctcctctcccaccgcatggccttccacaaccacctctcccaccaggacctctcctccctccaccacttcgccgccgaccagcagccgccgccgccgcagcaccagcagcagcagcagcacctgccggactcctcctcctccgtccaccaccagctccaccacgccgccggccccaactggctcaacaccgccctcctccgctccgacgccgcggcggcggcggcggcggcggcgggcggcaacagcttcctcaacctgcacacctcgtccgactccgccgcgtcgccgcaggcgcagcagcagccgccggcgacgtccgcgtcggccgcggcggggcaccaccagtggctgtcgcggcagcactcgtcgctgctgcagcggaaccacagcgaggtcatcgacgcggactcgatcatcgactcggcggatttgaaggagagcgtgagcaagggggacggcgggggcggcggggccgcggagagtaattgggagaatgccaagtacaaggcggagatattggcgcacccgctgtacgagcagctgctgtcggctcacgtggcttgcctgaggattgccacgccggtcgaccagttgccgaggatcgacgctcagctggctcagtcgcagcatgtggtggccaagtactcggcgatgagtcaaggattggtcgctgatgataaagagcttgatcagttcatgacacattatgtcctcttgctttgctcttttaaagaacaactgcagcaacatgtccgtgtccatgccatggaagctgtaatggcatgctgggagattgagcaatccctgcaaagcttaacaggtgtttctcctggtgaaggtactggggcaacaatgtctgatgacgaagatgatcaagttgatagtgacgccaacttgtttgatggaagtttag

SEQ ID NO: 46 - DNA, 391 bp, Eucalyptus grandis
ccaacaagtcatatatcctcgacttgctcccagtggaacgccttccattacttaatcgctgctagcgctaaacccccctcactcttcaccagcaaaaacgccttttctcgcacacaaatgggtcgtcgtaaaattgaaatacagccaataacgcacgagcgaaaccgatctgtcacattcctcaagcgcaagaacgggctgttcaagaaagcgtatgagctcggtgtgctctgctctgtcgacgtcgctgttatcatctttgaggatcgcccagggcacagccccaagctctaccagtactcgtctcgcggtatccaggatattgtgcagaggcatcttcatcacgatggcgagactgataaccgtggccctggggacttttcgggcgctg

SEQ ID NO: 47 - DNA, 821 bp, Eucalyptus grandis
ctaccgtaccgcctcacttaaatatcatcgccgtttgtcttcttgctcaactgttccaaatcccaggatcacagcaaagattcccttcaccatagcacgagcctccggctcctgccgagccgtccaagccgaaatagccacgctagggaaccaggtccatgtaacgcttcgtaatcaattgaatgaaggaagcacagagggcgagccagcgagcgagtgaaggaatagcgcctcccgacacccgtatataacagcaattcaagaactgcgcttccccacaatcttcccagtacaagctctagacggtctcgactcaaaggcatggataaagtaagtgcttcgtgtaattagactcaaccaccttctctgattccccatatatacccaccagaacgtcaatcaagcagagcagcagcaccgttggcttttaagatgtttagtacgggagaatattctgctgctgccttcgaaggcatggactcgctcccgagcccaaggaagaagaagaaccagctggtgaacagaagaaggttcagtgatgaacagatcaggtcactggagtctatctttgaatccgagtcgaggctagagcctcggaagaagctgcagctcgctagggaattggggctgcagccccgccaggtggccatttggttccagaacaagagagcccgatggaagtccaagcagctggagcgtgacttcgccattcttcgcgccaactacaacgccctctattcccggttcgagtctctcaagaaagagaagcaatccttggtcactcagattgagaaactaaaccaactcgtcgagaagccgca

SEQ ID NO: 48 - DNA, 648 bp, Eucalyptus grandis
cagaagcatctcgtttcaggcaaagcatgaaggttcatcagttcgcacgtggattctttgagctcgaacccaccaccctcacgctcgggtgcaaacgcctccgccccctcgttccaaagctcccccaccagaccgacgtggtctcgactgccgcatttgtcgacatcaagagcttcatccgcccggagagcggcccgcggaggctcggctcctcctctgacgacaagagagaccctcctcaggtggaaacacatccaggagggacacgttggaacccgacacaagagcaaatcggaatactcgagatgctgtacagagggggaatgagaactcccaacgcgcagcagatcgagcagatcacggcacagctcagcaagtacgggaagattgaaggcaagaacgtgttctattggttccagaaccacaaagcccgcgagaggcagaagcagaagcgcaacagcctcggcctctctcactgctcgagaacccccaccacagccgccaccatcgccactgtaactttgaacactactaaggtacacagaaccatactaccatatttttttcctcattccggcattggtgtcagagcgctgcatgatgcatgctgacctcgacagttggttcgtcggactcatgcttcatgtg

SEQ ID NO: 49 - DNA, 559 bp, Eucalyptus grandis
tattccctctcaattttagcttctagcgttctttttcccccattttatcaaatataatcatcatcacgatcgccctcccttttcctctctctatttctctctctctctctctctctctttctctctctctctctcggagcttcagcaagactgtcaggctaaactgtggagtctcaaagattccaacaggaggagtgcgtgcataaggctcaggacatgacttgcaactagcgagggattggactgatggccttcttttcaccaaatttcatgcttcaaagcccgcacgatcaagatcatgaacaccctcatcaccagcatcagaccagatcctctcctcttgcacgcctcaggacttccatggtgttgcctccctattgggcaagagatccatgtccttcacgggcattgacgtgggcgacgaccccaacatcaacaacggcaacgttaatggggaggaagatctgtccgaagatgatgggtcgcagccagggggagagaagaagaggaggctcaacatggaacaggtgaagacattggagaagaactttgagcttgg

SEQ ID NO: 50 - DNA, 486 bp, Eucalyptus grandis
gggaaggcgaccgcttccggcggcggtggcgggtacatgagcagcccggtccctctcgggcctttcacgggctacgcgtcgatcctcaaggggtcgaggttcttgaggcccgcgcagcagctgctggaggagctttgcgaagctggccgcgcaatttgtaccgagaaaatgacggatgattcgtgcgcgatgacggagcctgccatggacagcttgagtggtggttgtgggattggtatggacgatggttgtggtggagacggcggcgagttccgccggaagaagtcgaggttaatctcgatgcttgacgaggtctgcaggaggtacaagcaatactgtcagcaaatgcaagctgttgtagcatcattcgaatgtgtggcggggcttagtaatgcagctccttacgcaaacttggctttaaaagctatgtccaaacattttaagtgcctgaaaaatgcaattgctgaccaacttcagttcaccaac

SEQ ID NO: 51 - DNA, 726 bp, Eucalyptus grandis
tttctctctctatctccatctctctctctctctctctcttggatcaagccgaaatctctctgctcaatccctctccgatccgatctccgccgccgccgccgccgccgtcgctggacctcgatctcctctcctctcctctcctctcctccgccgcggagctctccggcgatcccgcctcgcttcggctttagggttttcccctttcccccggggtggtcgcgatttcggcgaggcattgtttcggatttcgcggggggatccatgggtcaacagtcgctgatctacagcttcgtggcgcgggggacggtgatcctcgccgagtacacggagttcaccggcaatttcacctccatcgcctcccagtgcctccagaagctccccgccaccaacaacaagttcacctacaactgcgacggccacaccttcaactacctcgtcgagaacggattcacctattgcgtagttgcagctgaatctgctggcagacagattcccattgctttcttggaaagaatcaaggatgacttcaacaaaagatatggtggaggaaaagctacaacagctgctgccaacagcctgaacagagaatttggtcccaagttgaaggaacacatgcaatactgcgttgaccatcccgaagaaatcagcaagcttgcgaaagtgaaagctcaagtatctgaagttaaaggtgttatgatggaaaatattgaaaaggttcttgaccgg

SEQ ID NO: 52 - DNA, 395 bp, Eucalyptus grandis
tgagtggtggagtgtccacaataagtggccttacccaacggaagccgacaagattgcgctggccaaatccactggcctcgaccagaagcaaataaataattggttcatcaatcagaggaagcgtcattggaaaccctcagagatcacacattataaagtcatttagacattttgttaaccattcttgcatgagttcaattacagagcatgtagaatcacaatgccttcccccttttttgggggaattaaagagtcaccaaggatgcgatgtacacaaagaaacaacatgagcgcagcaggaagcgatcacctaatgtcgcagcaagcacgacatccagttcacctcaatcagccactaatattgcccggggatactgtccatgagagcgaattgc

SEQ ID NO: 53 - DNA, 1700 bp, Eucalyptus grandis
cgaaaagggcagaggttaatgctctgcaccaaccgccttactctttcttaaacctctcaagcctctcactcttctgagctcattacttcacttacaacacactctctctccctgtattagaaggaaaggatgagtaaacaagatgtcatgaagatgcagacgtgtgttctcagagtgaacatacactgtgaaggatgcaagcagaaggtcagaaaactgctgaagaagaccgagggagtgtactctgctaatatagatgcggagcaaggcaaggtaacagtgctcggtcccgtagatccgtacacgctcatcacgaagcttgagaaatcagggaaacatgcggagctctgggggggatcaggaggacacaagaacggcacccaaaaccctcctccttcgctcccacaacaaccaccgcagtcggtttcgctccgtcgacgaatctgcacggaggaggagacggcccatggcgatgcaaactgggatagggctttccaagatcctggtcctcgccggagctggatacactggcacgatactgtttcagaacgggaagttgtccgacttgttgggcgagctccagggtttggtgaagggattagaaaaatctggtagccaatcagatggagataaagactattctgatgctgttgccgcacaggtgcgtcgattggcaatggaggtccgacagctagcctctgcacgtcaaataactgtcctgaatggaaattctagccaaatgggcaacttaactaatatggttgttccagcagctacactgggggcactgggatatggctacatgtggtggaagggtctttcattctcagatctcatgtatgtaaccaagcgcggtatggccaattgtgtggcaaacttgacccaacatctagagcatgtctccgaggctctcaactcagtaaagaaacatctaactcagcgaattgagaacttggatggcaaaatggatgaccagagggagctatcgaaagaaataaagaatgaggtttcttctgtaaaagccaatcttgatggtctgggtgatgacctggattttttgcagagaatggtttccggtttggatgtacgaatgggatcactggagtacaagcaggattgggcgaatgagggtgtgaggtatctctgtggtgtggctagcgggcagaaggtggaaatgccaaaaatgctgcaggagcaaattaagatttcaggcacctctcgaggattactctcatatcaggatactccaagtcttaagggtctgaaggaaatcgctgatgcattgaccttgagtattgatagatcagcttcagatgctgttgtgcaagatggagttgaaagattaaatggaaaaccaaagccattgccaagggctagttcaaccacatgttgatcgtagagtaatgtgaagttcccctcgcactgtggtactaaaccatggatgtacatgtgcttgttacaccacctttcgattcctcaaggttggactttggtagcatcagtcctcattgcagatgtaacggtagatttggtatgtaaatggaattcacttccaaagtatgagagattgagagttattatggcgatgcagattggtgctgtcaaagtaataatccggtgaatctcatcccgaatatttgctgctcttttgtattatttttcaagttatggtgtgaaaacctctgaagcggtttgtttcc

SEQ ID NO: 54 - DNA, 944 bp, Eucalyptus grandis
ctcttcctccctcctctgcaatttgcacggagccctcccgctctcgcttctttaacatgcccaccacctcctggtgcaacttcacctcgaggcctccgtgagctactgtgtgggcgtgcttctcttctcgtaataattctaatcctaacatggtgtggtatgcgagacaaaaccagaccagaccctccatggctcgtctagtccctttcctatccgtttcgtgacccacctgggcatctccaattactctctctctctttctctctctctctagggttttcgaagacagctcctccccctcgaagctcgctagggttttggatcgtcgtctcatctcgggtcgtgtttggaatggaggaatatggccagatgaacgagaacagtagcactgggtccagagggaacaacagcttcttgtacgcatcgccggttcttgggccgagctcctccggcaatagcaattacgggaggggaaatagcagcggtggccacttctattcccagtccggcgatcactgcttccaatccgaagcgccgccgcacccggtggtgaagactgaagcaaccacctctcaccacggccatgctcagaagtttcatcactattctctggtgagagaccatcatgacccatcagcttctcaccaccaccaccaccaacaccaccagcatcagcagctacaaacagcgagcgagagctcgcgcgaggtcgatgccatgaaggccaagatcatcgctcaccctcagtattccaacctcttggaagcttacatggactgccaaaaggtcggagcgccgcctgaagtggtggcgaagctgtcggtggcgcgacaggagttcgagtcgcggcagcggtcgtcggtggcttcggcggacgggtcgaaggacccggagctggatcaattcatggaagcgtattacgacatgctggtgaagtaccgggg

SEQ ID NO: 55 - DNA, 915 bp, Eucalyptus grandis
gtgaagaaggtgaagatgaacaggtcttgcagcccaagatcaagcggaagcgtagtctcagggtgcgccctcgtcacactatggaaaggccagaggaaaagtctagcaatggggcactacctgtacaatgtggagattctgctttcttgccactccaaatggaccacaagtatcaaccccagtcaaggactgcgtctgagaccaatccctttggagaacctactgcttccaagcatggtcatggtggtccctccatgaaaagcaagcgacaaacatctctaaggagaataaatgatccatcaaagctacatcccttgccaaaatctagcagatcaaatcacatttcgtcatcagatgctgctgcggaacgctcgagagaaaactggaatggtagagttgcaaatccttcaggaaattcaagtgttggtgccggtttatctgaaatcattcagagaaagtgcaagaatgtagtgagcaagctccagaggaggatagataaggaagggcatcacattgttccgctgctaactgacctttggaagaggatgggaagtcctggtcatatgggtggtgttggaagtaaccttttggatttgcggaaaattgatcagcgcattgagaaattggagtacggcgatgtgatggatcttgtgcttgacgtgcaactgatgttaaaaggtgccatgcagttctatgggttttctcatgaggttagatctgaagcgagaaaagttcatgatctcttctttgacatattgaagattgcatttccggacacagattttgaagaagtgaggaatgctctctctttctcgggccctggtgctgcatcccaatctgctccatcaccaaaacaggcatccgctggccaaagcaagagacacagggcattaaatgaggtcgatgctgacaaag

SEQ ID NO: 56 - DNA, 498 bp, Eucalyptus grandis
gtggtggggaaggctctgcagaaatgcgccaaaatttctacggatttgaagaaggcgctctatggctcttccgtcgcttcatgcgagcactactccgaagtggaagcttcctctaatcggattgtcactcaggatgatgttgatgcagcatgtggtgctgatgatacagattttcagcctgttctgaagccttatcagcttgttggtgtcaactttcttcttttgttgcatcggaagggcgtaggaggagaggggcagggggtgctaaaatatgatacatctctagctaatggtgcatctttgtactccatgcaagccatcctagcggatgagatgggtcttgggaagaccattcaggccataacatacttaacattgctgaaacacttgaataatgatccgggtccgcacttggttgtatgcccggcttctctcttggagaattgggaaagggaactcaaaaggtggtgtccttcattttcagtactccaatatcat

SEQ ID NO: 57 - DNA, 474 bp, Eucalyptus grandis
ccaaaggtaagttcgatcaactgtagatcataggagtaatttaaaccatgttcatggttgacgaccacgctttatgtttgagttgcaattgtacattcaacattctggcgtgttgcaattgcagctatcccaaagattcggacaaacacatgctcgcaaaacaagcgggactaaccaggagccaggtgtctaactggttcatcaacgctcgggttcgcctctggaagcccatggtcgaagaaatgtacttggaagagaccaagagccgagagcaagctgggtctgagaacggcacgactcgcagggccgccaccaaatccaacaaggacgctgctggtttgaagtccgcatctcaagaagacaatgcctttggaatgaacagctccatcaaatccttccaatcaagccccaacaaggccctcaatcaagccgccatttcaccctccgagaactccaactcgacttcctcaactt

SEQ ID NO: 58 - DNA, 489 bp, Eucalyptus grandis
ggagcaccagcctcgggtcaaagttcccatgcacttcaagtggaggaaacccgagattcacccctcgggtttgtggtgaaggtggaggaccgcctgagttccgggagcggtgggagcgccgtggtggatgaggacgggccgcagctcgtggacagcggccattcatattttcattgcaatgactacccgggaagcttggtggccgtcaatgggttgcagtcagaggacgatggaagcgatgatagccgaggttactgctcagagattttcgccgctgctgaagagccgcatcaggagggaggcgtgcctaatggggtggtgggcgtggccctagttttaggttttcgccttttggtatgttctcgtaaatggttcaagtcaaatatgtgctcatgagactatgcaatgtttcacgaaggggaagaatctgtaaacgtttactggaactttggacatgaataaaactgacgtgtttggtcaaaaaaaaaa

SEQ ID NO: 59 - DNA, 456 bp, Eucalyptus grandis
tctcgccttcaggcagtgaataggaagctgactgcaatgaacaaacttttaatggaggagaacgataggctgcaaaagcaagtgtcacagctggtgtatgagaacagttatttccgccagcagacacaaaacgcaaccctcgccaccactgacacgagttgtgaatcggtggtgaccagtggtcagcaccatttgactcctcagcatccaccaagggatgccagccctgcaggacttttgtccattgcagaggaaactttaacagagtttctttcgaaggccactggaactgctgtggagtgggtccaattgcctgggatgaagcctggtccggattccattggaatcattgctatttctcacggatgcactggtgtggcagcacgtgcatgcggccttgtgggtctagaaccttcaagagttgctgaaatcctcaaagatcggccgtcgtggtat

SEQ ID NO: 60 - DNA, 455 bp, Eucalyptus grandis
tgacgatgtttgtggaggaggaaagagaccggaaaggcctttcttttgcacatatgacggggaggaaaatggagacgatgattatgatgagtatttacaccaacctgagaagaaaaggcgattgtctatcgagcaagttctgtacttggagaagagctttgagactgataacaagcttgaaccagataaaaaagttcagcttgccaaagaactcgggttgcaacctcgtcaagttgctatttggttccaaaatcgaagggcaagatggaaaactaagcaaatggagaaggatttcgataaattgcaagctagttttaactgtttgaagtctgattatgaaagtcttctcaatgagaaggagaagctcaaagctgaggttattcatttgacacaccagctagagcaaaggagcaacggaattctgaaccattcgacatatctgaacaattgcacac

SEQ ID NO: 61 - DNA, 406 bp, Eucalyptus grandis
cccaaatcaaatgatatcgggtgaaagattttgagttttttttttttttcatttgaattgtcaccgtactttttccgaaaccgggcacaatggagaataaattcaggggtacaatcatttgagttcatacgacatgcctaattacatgaactgcgaaactcaaaagttcaatctttctccttcccctgcatcagcgcctaattctgaaaaaaattgagcgtcagcaagtgtttagggatggatttcttgttttgctagaggggggattggctatgggaattgaggaggccacgaagaggcaatcgattttcagctatcctgaggatctttacaacgaggaatattatgatgaccaggcgccggaaaagaagcgccgcctcactcctgagcaggtgcatctgttgga

SEQ ID NO: 62 - DNA, 530 bp, Eucalyptus grandis
ctctctactttttatcttcttcttcttctccgtcttcttcttcactgatcactgcaaaaaaaaagaaaaagaaaaaaaaaaagtactcctccgcctccgcctcctcctcctcctgctccgcagccgtacgcaggcgcgcacgctcgacagcgcattcctcctcccctcgttcgcggcggcaggcaggcaggcaggcaggcagacactgcgcgtgccatgagaagaaggccgtgatggaatgggagaagcaggaacagcaccacccccaccaccaccaccacccccaccatcacccgcagcagcagcagcagcaccaccagcagcagcagcagccgcagcagcagcagcaagcgaaggaggctcagcagcagcagcagcagcaggggggagagggcatgggtaacgggacggcggccgggaacgggggcggagtgctgtacgtgaaggtgatgacggacgagcagctggagaccctccggaagcagatcgccgtctacgcctccatctgcgagcagctcgtcgagatgcac

SEQ ID NO: 63 - DNA, 452 bp, Eucalyptus grandis
gcccggggccccgtcctgctggccgagtacaccgagttcagcggcaacttcaccagcgtcgcctcccagtgcctccagaagctccctgccaccagcaacaagttcacctacaactgcgacggccacaccttcaactacctcgtcgacgatggcctcacttactgtgtggttgcagttgagtctgttgggcgccagattccaatggctttccttgagcggatcaaggaggactttactcacagatacgacgcaggaaaagctgcaacagcatctgctaatagcttgaacagggagtttgggcctaaactcaaggagcacatgcaatattgtgttgatcatccggaagagatcagcaaacttgctaaggtgaaagctcaggtatcagaagtgaagggagtaatgatggaaaatattgagaaggttcttgatcgtggtgaaaaaatcgaacttct

SEQ ID NO: 64 - DNA, 354 bp, Eucalyptus grandis
gccaagtagcaccccgtttgccccacattatctgtgatatgtaaacgtggtgggcctctgttagctacaatatgattggcatcatttaagcttttgcgtaatcatcagtgttctcaatttgcaaaataccattaacggatcttgcagcatggaaagcattttagagaggtacgagagatacacttatgcggagcgacagcaagtggccactgattcccctcaagtgcagggaagttggtcgcttgaatatcccaagctcgtggctaggatcgaagtcttgcagaggaacataagaaacttgagcggagaagagcttgatcccttgagtctgagagagctgcagtatttggagca

SEQ ID NO: 65 - DNA, 1239 bp, Eucalyptus grandis
ctctctctctccttccccttctgactttgctcaagcttctttcctttctttaggataagtgctacatgagcttgtcgctttgtgtttgatctcaatttcgcacatgaaggtgatgaagctcactaatagcccatcttcttttctctctctctctctctctgcgcgatttgttttgttcagcgaaagaagaagagataaatattgaagtgaagtgaacagctgcgatggcgacttactaccaccagagctcatctgacccagatggagccctacaaaccctcgtcctcatgaaccccgccagctacgtccactactccgatgccccgcctccgcaccagcaaccctcggcgatcttcctcaactcctccaccgccgggccgcccgcatcccagacccagcaatttgtaggcatccccctacccggcagcgccgccgactcgcagccctcgtccatgcacgtcaaccacgatctctcctccatgcatggcttcatgcctcgcgtccagtataacctctggagctccctcgacccgtccacggcggcgcgtgaggcctcccgcacccaccagcagcaggggctctcccttagcctctccccgcagcagcccccaccgaccccagctgggtaccgttcctttgtccgggccgagcgcagtggcgatggagcagcgggttctcagcaccctccagcaatttcaggcggtgaggacgtgcggatctcgggcgggtccccatcgtcggcctcaggcgtaaccaatggggcggcagttgggtcgggcatgcagggggtgttgctgagctccaagtacttgaaggccgcacaggagcttctcgaagaggttgttaatgttgggaacaccggaatcaaagctgagatgctgaagaaggccagcggccaaagtaagccgggtggagaatcagcggcactgaaggaggaaggaggtggcgacggcagtggtaagcgcggcgcagaactgtctatggctgagaggcaggaaattcagatgaagaaggctaagctcataaacatgcttgatgaggttgaacagagatacagacagtaccacaaccagatgcagatcgtgatatcctcgtttgagcaagctgcggggattggctctgcaaggacgtacacggccctcgcgctgcagaccatctcaaagcagttccggtgcctcaaggacgcgatagcaggccagattcgggccgctaataagagcttgggcgaggaggatggcc

SEQ ID NO: 66 - DNA, 371 bp, Eucalyptus grandis
gttgagcaggtacagtttcttgaaaagagttttgaagtagagaacaagctcgagccagatcgcaaaatccagttggcaaaagacctcggattgcagccacgacaggtagcgatatggtttcagaatcgtcgtgcacggtggaagacgaagcagctagagaaggattatgaaactttgcaagcttcttttaacaccctgaagtcagactacgacactctcatcaaggagcggaatgatctgaaagccgaggttcttaacctcacggacaagctgcttcacaagggaaatgagaaggagagttccgagtcgtccagcaaatcatctcaagggctattccagaaccccattgctgattctgtttctgaggacga

SEQ ID NO: 67 - DNA, 387 bp, Eucalyptus grandis
ggccatcattagttccgatcaaatggagcgaaggatgttagaagcagctcggaagggcaatgtccatgagctggaagacttgatcagcagcaatgagctcatcctcgaggagatggatcttgaaggagccggtcacacgccgctgcatgtcgcctgtgtggctggccatttggatttcgttcgagagctcctgaagcgtacgccaaagcttgcggaaaaggtgaacacggatggtttcagcccgctgcacatcgcggctgctcgaggtgatgtcgagatcgcgagggagctcttgacaatgggtccacacctgtgctccgtgaagggacgggagagaagaatccctttgcattatgccgctatgaacgggaaggtcgatgtcatgaa

SEQ ID NO: 68 - DNA, 479 bp, Eucalyptus grandis
tccggctgtcgaaggaccagtccgccgtcctcgaggagagcttcaaagagcacaacaccctcaatcctaagcaaaagctggcactggcgaagcagctggggctgcggcccagacaagtggaggtctggttccagaacaggcgagccaggacgaagctgaagcagacggaggtggattgcgagtacctgaagcggtgctgcgagagcctgacggaggagaaccggcggctgcagaaggaggtgcaggagctgcgggcgctcaagctctccccgcagttctacatgcacctctcccctcccaccaccctcaccatgtgcccctcctgcgagcgggtcgccgccccgtctcccccctccgccgtcggccgccccctcgccgccgtcccggcccacccccgccccgtgcccctcatcaacccatgggcccctgcggccgctttagaaatagtggatccccccgggctgcaggaattcgatatc

SEQ ID NO: 69 - DNA, 684 bp, Eucalyptus grandis
cagaaagtgactcgccctagtgtaggagtagggagaggcttggatgcacattccatttcgcctccttgaagccctccaacggcgcagatatttccttgcttttttaggcaaaatgttgaaaaactggtgataataaaaagaagccctgtttagctataaagggaagccccatcctttctcctccctttctctttcttacctgtccccccctcccctctcctggctctcgctctctctctctctctcagttctttctcggacgggtgtctgtgcgtggcttttgatcggtcatcacctgaggccgcgtctgcaagcaagtgaagaaggaggacaaggaatatggcgagagagaagatcaagatcaagaagatagacaatgtgacggcgaggcaggtgacgttttctaagaggagacgagggcttttcaagaaagccggagagctgtcggtcctgtgcgatgccgaggtcgctgtcgtcattttctcggctaccggcaagctctttgagtactccagctccagcatgaaggacactcttgagaggtacaccctccaccacaataatcttgagaatatggaccaaccttctctcgagctgcagctggagcatagcaataacatgaggttaagcaaggaagtggcagaaaagagccatcgactcaggcagttgaggggtgaggatctt

SEQ ID NO: 70 - DNA, 356 bp, Eucalyptus grandis
gcaggttgctgtgtggttccagaatcgccgggctcggtggaagacaaagcaactggaaagggattatgattacctcaaatcttcgtacgattcccttctttcggactatgattccatcttgaaggaaaacgagaagctcaaactggaggtctattccttgacagaaaaacttcagggcaaggaagtcgatggagcaccaatgacaggcccctcggagccagctccgctggaggaggctgatgtccaggccgtccaattcagtgcgaaggtggaggataggctgagcacaaggagcgggggaagcgcagtgatcgacgaggaaggtccacagcttgtggacagtggcaactcgtacc

SEQ ID NO: 71 - DNA, 725 bp, Eucalyptus grandis
cccaacgcctccccaaacgcaacgcaaagattccatttttccctctcgccgtcgcgtgaaactccggccgccggcggcctcagatcaccccgcttcagcagcagcagcagcaagcgctgagcaaagaggagaaggtggctgctttcatggaggcccactgagtcttcagtccggagcttccgacccaagaaagggagagcagacgaagcagagggggagaggcaaagagagagatttgaggagctgggaagtgttttgggaaggagtggcatgatggggttttgcatatgtccgctggagacgccggcgaggctgctgtggacgaccagcttcttccgtcacaagctcatgctcttctaactcgcggcctccctgtgtagacatagtgtaaactcgtttgtacgtatatctacgtgttaagtgctttttttccagtgcctcgccggagtttcggtcaggctgggatacaggttgccggagatccacctcgggctgagaagggtatggaggcagggcgttttctgtttgatccccccgcgcttcaggggaacatcctcttccttgataaaggatcaagatccatgatgggcatggaggaatccccgaagaggcgccggtttttctgctcgccggacgaacttttcgatgaggaatattacgatgagcagatgccagaaaagaaacgtcgcctcactcctgagcaggtgcttctgctggagaagagc

SEQ ID NO: 72 - DNA, 523 bp, Eucalyptus grandis
ctgaagacccaaatcctccctcacttctaggtgcatagtttgatccctctcattctcatggatgaaatgtacgggctctgcggcggcggcggcggaggaggaggaggaggaggagaggagtactccgagagggcgctgatgtcgccggaaaacctggtgctgccgtcagagtaccaggcctggctgtgctcggccgggtttagggataatcgaatccccatgtacgggttcgggtcggaggagttcgtgtcgtcggcgtcgggcatgtccgagaccgcctcggtcacacccgaccaagaggatgcggcggagacagcgatcaagtccaagattaagtcccacccttcgtaccctcgtttgctccacgcctacatcgattgccagaaggtgggagcaccaccggaagtggtggggctgttggacgaaatccggccagagaacggcgtgtgcaagcgagacgccgccgtttctacatgccttggtgccgatcctgagctcgacgagtttatggagacgtacacag

SEQ ID NO: 73 - DNA, 646 bp, Eucalyptus grandis
ctaacctggccgtctctttcttcctgccattggctcttccttttgtattttcctctgctccctgctccctctctctctctaaaagcctgtgggcttatagggtccgttgaatggtctctctctctctctctctatcaatcgctctctacagagagcagagggaaattctcgagattggcgtctggggataaaagaccagcacagggaccatcttcttcattccctctctctcttcctcgactggaacaagaaaagctctgtgtgtagcggaggaagtgcgtccagagagagctctcttgctgcgggacattattctcatgaaggagataggaggctctcttcggcagagagagcccgcctccggagagagcctgcccgactgacccccgcgcagacattggcattcctccttcttcttccttccccctctcgagaacgttcggagaaaaaagcgacagagcggaacccgggactgcggatggcgctggcgatgcacagggagtgctcgagcaagcagatggacgcgagcaagtacgtgcggtacacccccgagcaggtggaggcgctggagcgggtctacaacgagtgccccaagcccagctcgctgaggcggcagcagctgatccgagagtgccccatcctctgc

SEQ ID NO: 74 - DNA, 471 bp, Eucalyptus grandis
ctcctctctcataagtcataattcacaggcgcggcacaaggcacgaaaagataaaaaaaaaaacgatggccggtgaggagccctattctgccgacacgaactcggacactttcgctgatgaagaaacgctgattccgagttcttccgaggctcttgagtccgcctgggttcctacttcctcgaccgctcatcatggttcaaaatcagtggtcaattttgaggacgtttgtggaggaggagacaccaatactgcgccgaggccatacctccgacagattgatctgaaggaagaagccgtcgaagaggactacggcgacgggaactttcagcctcctggtaagaagcggcggctatcggccgaccaagtccatttcctcgagaggcactttgaggtcgagaacaagctcgagcccgagaggaagatccagctcgccaaggacctcggcctgcagccgaggcaggtcgcgatct

SEQ ID NO: 75 - DNA, 766 bp, Eucalyptus grandis; identical to SEQ ID NO: 21

SEQ ID NO: 76 - DNA, 443 bp, Eucalyptus grandis
gttcttctccgattcttgacgaccgcaacaacaatatgcaacaacaacgcgggtggttcaggttcaggctcaggctcaggttgtttcttcatggacaacgatgtcaaggccaagatcatggctcatcctcactaccaccgccttctctcagcttatgtcaattgtcagaaggtgggagctccgcctggcgtggtggcaaagctagaggaagcgtgtgcatcggctgcgataatggccgggaacagcggcatgagcaacacaggttgcattggtgaagacccagctcttgaccagttcatggaggcctactgtgagatgctgactaagtacgagcaagaactctccaaacccttcaaagaggccatgctcttcctccagaggatcgagtgccaattcaaagcccttactcttggtgttccttctgattctgtggctttgagtga

SEQ ID NO: 77 - DNA, 529 bp, Eucalyptus grandis
tggaagcagtaaaggagtgggaataccccggcttcgttttttggaccagcagctcaggcagcaacgagccctacagcagcttgggatgatgcaacagcatgcatggaggccgcaaagaggacttcctgagagttctgtttctattcttcgggcctggctatttgagcattttcttcatccttacccaaaggattctgacaaaatcctgcttgcaaggcagacaggcttgacaagaagtcaggtctcgaattggttcatcaatgcaagagtgcgtctctggaaacctatggtcgaagaaatgtacaaagaagagattggggatgcggaaatggactccaactcatcctccgacacagccaagccaaaaacaggagatatcaagtcctccatggaggaccgggtggaagaagtgcaacagagttcaacagctacacagagatgcagctcaggccagctcatggactcatcattcgaccggactccagatgtcgaaatggcaggccactctgtgggattcaactacctgaac

SEQ ID NO: 78 - DNA, 941 bp, Eucalyptus grandis
acttaatgcaatctgcaaggttaagggttatgctgacccattacaatatcagagttgatgtctgaggtgcaagtcactcagatgaaatctgatggtacgctagaggagagtggtgaggcacggcgacttagaaattctttggaggaaatggcaaacgaaggcaagagccctagcatattgaaagaatgtggtcttccagaaaattctttcgtctcaattccacaaaaaatgacagaaaatcggtggtcctggtcggaggtcaaatatctctctaattgccttcttttggcactagatgcaagccttgagcattctcttttgggatctctgatgaatatggatagatatgctgctgcagagagttatcacaaacttgctatggcttttgcccctgtcccggatcttcacattatgtggttgttgcacttgtgtgatgcacaccaggagatgcagtcttgggctgaagctgcacaatgtgctgtggctgttgctggtgttgtaatgcaggccctagtagctagaaatgatggtgtctggagtaaagaccatgtgacggcactacgtaaaatttgcccaatggtcagcagtgagatcagctgtgaggcatctgctgcagaggttgaggggtatggtgcttcaaaactcacagtagactctgctgtgaaatatctgcagcttgcaaacaagcttttttctcaagctgagctttatcatttctgcgcaagcattctggaactcgtgattccagtttacaaaagcaggagagcatatggacagctggcaaaatgtcacaccttgctcaccaatatctatgagtcaatccttgagcaggaatccagcccaattccttttacagatgctacatattacagggtgggattctacggtgaaaaatttgggaagctggataggaaggaatacgtttatcgggagccccgtga

SEQ ID NO: 79 - DNA, 436 bp, Eucalyptus grandis
cccacaccaagactcaccaccatcactcaatcgcaatctccaaccccaccaagtctatgtcccaagactatcaccaccccagcatcttcgccttctcaaataacggcttcgagcgacccgacgttgccgcggcctccgctgcctcagaccaagaacagcagcaccatgtagcccagcagatctgccgtgacaagcttcgagtgcaaggctttgaccaacctccaccgccacaactggttggcatggaggaggaaccaggcgggctgcccgcgtacgagaccgctgggatgctatctgagatgttcaatttccctcccggcggtgcagccgctgccgaattgctggagcagccgatggcgtcgggttatcgggctgcccggccatcactgccaaccgtgagtggtacggctcaaaaaacccaggtgtgtataggcga

SEQ ID NO: 80 - DNA, 377 bp, Eucalyptus grandis
atcgttgatcacatggatttagagccatggagcgtgcctgaagtattgcgcccactttacgagtcgtcaactttgctcgcacaaaggacaacgatggcggctttacgcaatctgaggcagatctctcaagaagtttcccagccaaatgtcactggttggggaagaagacctgcggcactgcgtgctttaggtcagagattgagcaagggttttaacgaagctgtcaatggatttatggacgatggttggtctatgttggaaagtgatggcgtcgatgatgttactcttctcattaactcatcgccagccaagatggcaggcgtgaacatttcttacgcaagtggttttccttcaatgactagtgcggtcttgtgtgc

SEQ ID NO: 81 - DNA, 478 bp, Eucalyptus grandis
aggtttgtcgatgccactggtgttcttctgagtctagattgatagagaaggaccggaagtcaccaagaaaagggtcttatctggtttcttgatagccttttttggttttgtattgagaattcacttcgttcagagaggagagagcctgtgagagtagtgatcggagatggcgacggcctttgcagggacgcagcagaagtgcaaggcctgtgacaagaccgtgtatctagtagatcagctcactgctgacaacaaggtcttccacaaggcctgcttcagatgccaccattgcaagggcactctgaagttgagtaactattgctcctttgagggtgttctatattgcaagccacatttcaatcagctctttaagatgactgggagcttggataaaagttttgaaggcactccaaaaactgtcaatagatcttctgagcagggccaaagtaatgccaaagtctcgagtatgtttgccgga

SEQ ID NO: 82 - DNA, 493 bp, Eucalyptus grandis
cagatgatgatgaggatgacgatttgtttcaagatcgttttagcattgcatacaaccttgaccgagagtttgggccaagacttaaggagcatatgcagtactgcatgagccatccagaggagatgagtaagctatccaaattgaaggctcagatatcagaggtcaaagggattatggttgataatattgaaaaggtgttggaccgtggggagagaattgaacttctggttgacaaaacagagaacctacaattccaggccgacattttccaaaggcaaggaaggcaactgcgtaggaagatgtggtttcagaatctccaaatgaaggttgtggtggctggagcagttgtcatagtaatattcttgctgtggcttatagcaaagtggggaagtaaataaaacttgttctcaggatgtaaaaagaaaaggtacaatatgattttgtatctggatatgtttgttggtatgtggagctagcctaccacttaggattt

SEQ ID NO: 83 - DNA, 764 bp, Eucalyptus grandis
atgcattctcaacaaatacagtcgattgccttatcagcaggaaacattagtgaaattatgcaatccaaacttcaatgcgctgcttccaccagtttctcttccttcttatcctttttgcccccagtgaagaatttgtaccctccatagataagcacaccccaaccagacaaagacacaattacaaaatgctcttccttccatttagatggactcaaagggtcatcccaaacattaactcttggtggtccatggtgatccgccgcgccggcgaggccgcgccgctggccgaaggcggcggcttgggccgacagccccggagaggaggcgcgcgagagagcggcggcccggcgagctgcgatcgcggctaacgcagtagccatggctggatcgagagagagaggagagagtgtgctcttgatagccttttttggttttgtattgagaattcacttcgttcagagaggagagagcctgtgagagtagtgatcggagatggcgacggcctttgcagggacgcagcagaagtgcaaggcctgtgacaagaccgtgtatctagtagatcagctcactgctgacaacaaggtcttccacaaggcctgcttcagatgccaccattgcaagggcactctgaagttgagtaactattgctccttcgagggtgttctatattgcaagccacatttcaatcagctctttaagatgactgggagcttggataaaagttttgaaggcactccaaaaactgtcaatagatcttctgagca

SEQ ID NO: 84 - DNA, 490 bp, Eucalyptus grandis
ggtttatgcccctatcgattcaacagcgatgaccatcgcgttgagcggcgaggacacttccacagtgcaaattcttccatctggcttcacgatctccagcgatggccggattggcacaagctccagcaagccagcaggtacacttctcactgtggcgttccagatattggtttccagccactcaggtccagagcagctcagcgtggaatccgtggcgaccgtgaacactctcattagtgcgaccgttcagaaaattaaggctgctctaaattggtctgccgcggaatgatttttttttttttttaatatttgactaggcggaatgatccttctatttgtgttgatggtttgtaccgaaagatgagatgatataatttcatagcgagatgatttaatttcacatcgtcaccaacacgtggtgagtacaaccagttcctgtccataatgatctaagttggtgtttatattggaatgactttttgcggaactg

SEQ ID NO: 85 - DNA, 427 bp, Eucalyptus grandis
atcaaatggagagagcagctcgaaagggcaatatccatgagctgaatgacttgatcagcagcaatgagcaaatccttgaggagatggctcttgaaggagccggccacacgccgctgcacatcgcttgtatgggcggccatttggatttcatccgagagctcctgaagcatatgccgaagcttgcggaaaaagtgaacccgtgtggtttcagcccactacacatcgcggcagctcgtggtgatgttgagatcgcgaaggagctcttgaaagtgaatacagacctgtgctccgtggagggacgggagagaagaatccctttgcatgatgctgtcatccacggggaggtcgatgttatggagatactactatctacttcacctgagtctgttgaaaagaaaaccgcccggaaggagaccgtgcttcacct

SEQ ID NO: 86 - DNA, 365 bp, Eucalyptus grandis
gccaagtgacatcttcctcttgcaactttgcaatggagtggatgaaaatgctgttggcacttgtgctgaactacttttcgctccaattgacgcatccttttctgatgatgcacccattattccttcgggattccgcatcattcctcttgatccaggatcggatgccttcagcccaaaccggacacttgatcttgcctcagctcttgatgttggtcccacaggcaacaaagcggtcggtgataattctggtcatagtggaaacaccaaatctgtgatgactatagccttccaattcgcatttgaattacatcttcaagagaatgtggcgtccatggctcgtcaatacctcagaagtattatagcat

SEQ ID NO: 87 - DNA, 180 bp, Eucalyptus grandis
tttctctcttttctctcaagctctctccttcatcttcaagaacacaagaccaaatcaatctcccccatctcctcaaatgggcatagatgatctgtgcaacacaggccttgttctgagtcttggcctcgagacgcccttcaagatcgaagcccagaggcaagccaaacagcgccttaactt

SEQ ID NO: 88 - DNA, 468 bp, Eucalyptus grandis
aaatcaatgcccccgaaagcgacccttcacttacacccgccatcaatagacaccccttctcggagacccaggccaccaccctcctccaggccaccaccgccatgatctcctccgctgtccaggtggcgggcccggcgcacatagatgacccctgccgccgcagcatcggaggcagcacgggcttaggcggcgccacggacatcgggtccgcgctgatccggtttgggacagccgcggcagcaacgggcgacgtgtccctcaccctggggctgcgccacgccgggaatgtgccagagaagagctctttctcggttaccgacttgggcggctgttaattagtaattaaatttttgcctgtcatctagctacctttgggaaaaaaaacaattttagaaaaagaaaacctttctttttcctccattatcattaatctagcttaaaaacaagatacaccaaccctcaggaaac

SEQ ID NO: 89 - DNA, 441 bp, Eucalyptus grandis
cttcaatgaaggaaatggtaccccaagcaaacagaaaatcaaagagattactaccgaactgagtcaacatggacaaatttcagaaacgaatgtctataactggttccagaaccggcgtgcacgatccaaaaggaaaatgcagaatgcaaccggcaacaatactgaatctgaagctgaagcagaagttgagtccccaaaggagatgaagacaaaaccggagatctttcaatctcagcagaatcctgtatcaaggaacgaagatttatgcttccaaagccctgagattagctcagatcttcattttgctgattcacagaccaaagtggagagcatggtttatccagatggcagtttgagatccaggaataggaacctaggccagctatctttctatgatgccatgatgtcaaattcaggcggtcttgcaggaaatgagcatct

SEQ ID NO: 90 - DNA, 744 bp, Eucalyptus grandis
ctcctattgatgaatctttcgcagatgatgctcctttgttgccatctggctttcgtgtcatacaattggatcctaaaacagatgggcctgcccctactcggacattggacctggcctctacgctggaggtgggatctggtggtgctcgtcctacttgtgaagctgatgctagcacctacaacctgcgatctgtcctcaccatcgcattccaattcgtgtttgagaaccatttacgggacactgttgccatcatggctcgtcaatatgtgcgtagtgttgtgggatctgtccagagggttgccatggcaattgcaccttccaggctaggtggccatctggggccaaaatctctctctggttctcctgaagctcttacgctggcacgatggatctgccgtagctacagaatttgtgctggagctgaactgttgagaggggactcccaagctggtgatgctgttttgaaggaattttggcaccattctgatgcaattatgtgctgctctgtgaatacaaatgtggcctctcctgtcttcaccttcgccaaccaagctggacttgacatgcttgaaactactctggtggccctccaagatattatgctggaaaaggttcttgatgaaggtggcaggaaagttctttcttcggagttcccgaagatcatgcagcagggtatcgcctatctgccagccggagtatgcatttctagcatgggaaggccagtggcttatgagcaagccgttg

SEQ ID NO: 91 - DNA, 509 bp, Eucalyptus grandis
gtccggctcactaaggaacagtctgctcttctggaagagagcttcaaacagcatagcactctcaaccctaagcaaaagcaagctctagcgaggcagttgaatctacggccccgccaagtcgaagtgtggtttcaaaacaggagagccaggacgaagctcaagcagaccgaagtggactgtgagttcctcaagaagtgctgtgagacgctgaccgacgagaaccggcgattgcagaaggagctccaggagcttaaggccctgaaactggcccaacccttttacatgcacatgcccgcggcgaccctcaccatgtgcccctcgtgcgagcggattggtgcgggcccgagcgtcgacggcgcagcgccgacgaagggccctttttcgatgacgacaaaatcacacttatacagtcatcactttaccaatccatctgctgcttgctgattagaagttattagggttttagagatattacagagagagagagagagagagagacatatatagac

SEQ ID NO: 92 - DNA, 363 bp, Eucalyptus grandis
ccattagagtttcacaatgacgtgagacttaccttcagcaatgcgatgacctataatcctcccagcaatgatgtccacttgatggctgatactctcaacaaattttttgacattaggtggaaaaccattgaaaagaaacttgttgtcggtggaccacaaccatcatcaacaaaatcagctccacctgaggaggtaaaagcagccaagtcaacagctcttcctaaaaagaggaaaatgtcgagtcaacaagaagttatgcctgcacctcttcttcaggtaatgacagatgaggagaagcataaactaggccaggaattggagtctttgctgggagagatgcccgaaaatattattgattttttg

SEQ ID NO: 93 - DNA, 110 bp, Eucalyptus grandis
acatgcagctctatgcgcctaccactctggcaccggcccgtgacttctggttgctgcgctacacatctgtaatggaggatgggagtcttgtggtatgtgaaagatcaatt

SEQ ID NO: 94 - DNA, 440 bp, Eucalyptus grandis
acagagagctcaagactcagctcttgcggaagtacagcggatatcttggtagcctcaagcaggagttcatgaaaaagaggaagaaggggaagctcccgaaagaggcccggcaacaattgcttgattggtggagtcgacactacaaatggccttacccatcagaatcacagaaactagctctagcagaatcaactggactagatcagaagcaaatcaacaactggttcatcaaccaaaggaagaggcactggaagccatcggaggacatgcaattcgtggttatggatgccactcaccctcattactacatggacaacatgctcggcaatccctttcccatggacatctctccgaccttgctttgaagtctatggttgatattgctaatattattcgaccctagtgtcattatgagctctaaatgtgctctttccgagtgc

SEQ ID NO: 95 - DNA, 413 bp, Eucalyptus grandis
cttggccattcaaggaaccagttgatgctcgtgaggtccctgattactatgacataattaaagaccctatggatttgaagacaatgaccaagagggtcgaatcagagcaatattatgttacgctcgagatgttcattgcagatgtcaagaggatgtttgctaatgcacgcacctacaattcccccgacactatatacttcaaaattgcaacaaggctggaagctcatttccagagcaaggtacaatcgaatctccagtctggtgccggaaaaattcaacagtagagcattcggtagactggaggccctgaccttacttctctctatatgaatatgtggagccttggatacttactctgatccatgattgcgctggggaattaactagcttcgattgaccatgtaactgaagac

SEQ ID NO: 96 - DNA, 706 bp, Eucalyptus grandis
ctttggctttccttctccatctctctcgctctctctttgggattcgtgtgttctttcttcttttttgcaccacccgagattttccgaaagctgaagtggccggggagtgaagtttaagagagagagagccatcaccaaaagcccgaagatcatggggagaggaaagatcgagatcaagaggatcgagaacacgacgaaccgtcaggtcaccttctgcaagagaaggaacggactgttgaagaaggcctacgagctctccgtcctctgtgatgccgaagtggccctcatcgtcttctccagcagaggacgcctctacgagtactccaacaacagcataaggtcaactatagagaggtacaaaaaggctaattcagatagttcaaacacaagcactgtcacagagatcaatgcccagtattatcagcaagaatctgcaaagttgaggcagcagatccaaatgctgcaaaactccaacaggcacttgatgggtgattccttaagttcactctctgttaaggagctgaagcagctggaaaataggcttgaacgcggcatcacaaggatcaggtcaaagaagcatgagatgttattgactgagatcgagtacctgcagaaaaaagagattgagctcgaaaatgaaagtgtgttcctccgcacaaagatagccgaggtggacaggattcagcaaggaaacatggttgctgcc

SEQ ID NO: 97 - DNA, 396 bp, Eucalyptus grandis
gaaaaatggggagagggaagattgagataaagaggattgagaatgcaaatagcaggcaagttacattctcgaaaaggcgttctgggttgctcaagaaggcgcaggagctctctatcctctgtgatgctgaggttgctgtcataatcttctcgaatactggcaagctttacgagttctccagttctggaatgaaacagatactatcaagatacaacaggtgtcaagattctccagagtccactgttgtagagtacaagccagagtctacgaaagaagatgataaggtggtagacaccctaaaagatgaaatcgcagagctgcagatgagacaactaaggctactgggcaaggacttgaatggcctgagcataaaggaattgcagcaccttgaacagc

SEQ ID NO: 98 - DNA, 379 bp, Eucalyptus grandis
ctcgatacagctcttaagcgcatcaggaccaggaagaaccaactcatgcacgagtcgatttctcagctgcaaaagaaggaaaaatctctacaggagcagaataacgtgctctctaaaaagatcaaagaaaatgagaaggtaatgagagagagtggacaatgggagcagcaaaccccagcaccgaccacatcctccttcatgctacaacccactttgcctcttccttccctcaccattggcaacacgttccagacaccgcatgtacttggaggagcagaacaagaggagagatctcaagcccgaccagccaacacgctcatgccgccttggatgatacgccgttcaaatgaatagagagatagagaccaacaacattctc

SEQ ID NO: 99 - DNA, 421 bp, Eucalyptus grandis
gtacttgtctgacttgatgagcagtgggcacaagcacaagaggaggaagcagttgcagacggtggagctgaaggtgaggatggactgtgatggctgtgagctcaaggtcaggaaggccctctcttctttagacggagtgaagacggtggagataaacaggaagcagcagaaggtgacggtgaacgggtacgtcgaccagaataaggtgctgaagagggccaagtcgacggggaagaaggcggagatatggccctacataccctacagtgtggtggctcaccagccgtacatcgcccagtcctacgacaagaaggcacctcccggccacgtgaggaaggtcgagccaaccgccaccagtgccatcgtgacccggcacgaggacccttacatgaccctcttcagcgacgacaaccccaatgct

SEQ ID NO: 100 - DNA, 460 bp, Eucalyptus grandis
aggatcgagaacaagataaaccggcaagtgacgttcgcgaagcggaagaacgggctgctcaagaaggcgtacgagctctcggtgctctgcgacgccgaggtcgcgctcatcatcttctccagccgcggcaagctccatgaattctgtagcggcccaaggtatcgcgtatttgtatgttatcacttgtttttctcgttaatgttatgatgagacatcagggggagaaacccagaactgagatcacactgtttcattaaattctctcgtccaaattctttcgggaaaccctcagatcttggtgatctggatcttggtgctgccctaaggagatggcgatttattggtttttcttcttttttgggtttcagtttcttgactctttttgcgatctttccgttcaccatgaaaaaaagctttcagccgcacagtttcttgcttcctggggtttctgatcttctct

SEQ ID NO: 101 - DNA, 423 bp, Eucalyptus grandis
gatcaatgctggtcgctttgaccagagaacaacgcacgaggagagacggttgactctggaaacattattacatgatgaggaaaggtatcaagaaactgtgcatgatgttccctctctgcaggaggtaaatcgaatgattgctaggagtgaagaagaggtcgagctatttgatcagatggatgaagaactggattggacagaggagatgaccaattatgaactagtgccaaaatggcttcgggccagtacaaaggaggtcaatgctgctattgccactctatcaaagaaaccatcgaaaaacactttgtttgctagcacaatagtggaacctaatgaaccggtatcggaatcagtgagaaagagggggcggcccaagagtaaaaagcatcctaattacaaggaactagatgatgacaatgaaga

SEQ ID NO: 102 - DNA, 381 bp, Eucalyptus grandis
ttgccgcccaactgaagcacagctgcgagctactgggtgagaaggacggcgcgggcagctccggtataaccaagggcgagacaccacggctcaagttgctcgaccagagcctgaggcagcagagggctttccaccagatgggcatgatggagcaagaggcctggaggccgcagcggggcctgccggagcggtcggtcaacatactgcgtgcatggctcttcgagcatttcttgcatccgtatccaagtgacgctgataagcatctgttggctcgacagactggtctctccagaaaccaggtctcgaattggttcataaatgccagggtccggttgtggaaacccatggtggaggagatgtaccagcaagagtccaaagaag

SEQ ID NO: 103 - DNA, 473 bp, Eucalyptus grandis
ctctattccactcctaattcatgcttttcgtgacaataattttgtagcatgctcaaaactctagagagatatcagaagtgcaactatggagccctggagccgaacgtgtccgcgagagaatccttggagttaagctgtcagcaggaatatttgagacttaaggcacgttacgaagccctacagcgaactcaaaggtattgaagtttctattgtccttttaattaaatgtcagcattcgcgggatgtagttattttcctacatgattggggtctatctgtgtcatcgtgaactaggaatcttctgggagaagaacttggccagttaagcagcaaagaactcgagtccttggaaagacagctagatgggtcattgaagcagatcagatcacgaagagtatgtaaattatattcacgaattctatctaagtcacatcctgagttattgtgaatacaagttactgtgtcaatcgctg

SEQ ID NO: 104 - DNA, 634 bp, Eucalyptus grandis
caaaaatagaggatgttagggaggagatactacggaaaaggagagccggaaaattacccggcgatactacttctgtgttgaaaaattggtggcagcaacactcaaagtggccatatccaactgaagatgacaaggcgaaacttgtggaggagacaggattgcagctgaagcaaataaataactggttcatcaaccaacggaagcgaaactggcacaacaattcccaatcggtcacctccttgaagtccaagcgcaagaggtaggcgcaacggaccatcatgcttgtctttgtgccgctaactgaaacacgaaacttatcaatcggtattgactctgatataaccttctgatcgactgggggtatactttatagctagagctgaacacttgtggtggtggatcaagcagtgatggtaagtagatgattcattatggaattagggcctgtaacaaatgatgcaaattccagtagattacatacacaaaacccagaaaattgatgtctttttgtttggttagaagtgcttctgttgcctaatctctcttgtatttaggcccaaaacaaacaacatgttgatttgttttctgtttttataaaattgttgtttttggcagtaaaaaaaaaaaaaaaaaa

SEQ ID NO: 105 - DNA, 483 bp, Eucalyptus grandis
ctccagtggatatcacaggaatgcaggcggtgatgaccggctgtgactctagcaacatagccgcactgccatccggtttctcgatcctgcccgatgggatcgagtcgaggcctctagtcatcagctcaaggcacgaggagaagagctcagaaggaggatcactgctcacaatagcttttcaaatcctaacaaatacctctcccacagccaagttaactgtggaatctgtggagtctgtcaacactctcatatcctgtacattgcggaatattagaacgagcttgcaatgtgaggatggatgacaactttaagttttatttaaagtagatagggataattaactgtacaactaatagggtggagaaaaattagcagttcaaaagcaatggctttttttcatttgttctttggttggattggaaggcttggcttggttttaagcatgtttttatgcagaaagtggtgactggcgggcaagagaga

SEQ ID NO: 106 - DNA, 404 bp, Eucalyptus grandis
tcgagaacaagatcaacaggcaagtgacgttcgcgaagaggaggaatgggctcctcaagaaagcctacgagctctccgtgctttgcgacgcggaggtcgctctaatcatcttctcccatagaggaaagctgtacgagttctgcagcagctcaagcatgctcaaaaccttggaaaggtatcaaaaatgcaactatggagcaccggagcctagcatctctacccgggaagcacaactggagctaagcagtcagcaggaatatctgaaacttaaggcacgctatgaagccctacagcgaacgcaaaggaatcttcttggggaagaattaggccctctgagcagcaaagaactggagtctctggaaaggcagctcgattcatccttaaagcagattcgatccactcga

SEQ ID NO: 107 - DNA, 527 bp, Eucalyptus grandis
gctagaaaagcgatccattggtcaggcagcagaacagctttatctattctcttgtacgacgcgcagtagacgaagtaacatagcccaccatatgcaagagccgaacttggccatgatgggcggcggtggtggcggcggcggcgggggcggggggatcgtcggtggcggcggcggggggctgggcagcgaggcgtcgttctcgggcgatcacccgcagcgccagctcaagggggagatcgccagccacccgatgtacgagcagctgctgtcggcccacgtggcgtgcctccgcgtcgcgaccccgatcgaccagctgccgctgatcgacgcgcagctggcgcagtcgcaccacctcctgcgctcctacgcctcctcggtgcagcacggccacagcagcctctctcctcacgacaggcaggagctcgaccatttcttggcacaatatctggtggtactatgcagcttcaaagagcagctgcagcagcacgttcgagtccatgccgttgaagccgtcatggcctgtcgtg

SEQ ID NO: 108 - DNA, 482 bp, Eucalyptus grandis
cccatcccgatgagaagcaaaggcagcaactgagcaaacagctgggcctcgctcctaggcaagtgaagttctggttccagaatcgcagaacgcagctcaaggcaattcaggagcgccatgagaattctctgttgaaaacagaaatggagaagctcagagatgaaaacaaagccatgagagacaccatacagaaatcttgctgccccaattgtggctcagccaccacaagcagagataccgccttgacaactcaggagcagcaactccgaattgaaaatgctcgactgaaagccgaggtcgagaagctccgaacagctctaggaaagtacactccagggacggcatcgccttcttgctcagccgggaacgaccaagagaacaggagctccttggatttctacaccggaatctttgggctcgacaagtcgaagatcatggaattggtgaaccaagcgatggaagagctcaagaagatggctact

SEQ ID NO: 109 - DNA, 343 bp, Eucalyptus grandis
ctcttcagctgaaccctccctctccccatctctcttttcttgctatgaccaacgacaagaacaccaggaacaaaaaaaaaaaaaagctccaataaaaaatctctacagggagagagagagagagcaagaactcaagaaaccctaaacttatctagccccgtgtcatcgaagagagcgagggagaaggagagggagagggagagggagagggagagagagggagtggaagtggaggaacgagcgagagaggaggagggagtgtactgattaatcggtatctttctatttatgtgcaagtggaattataataaggtggcctctccttttctccccttctttttct

SEQ ID NO: 110 - DNA, 617 bp, Eucalyptus grandis
ctcatccgaccttgtgagggaggtggtgcaatcattcatattgtggatcatgttgatctagatgcttggagtgttcctgaagttctcagaccactttatgaatcgtccaaaattcttgcacagaagatgactgttgctgctttgcgccatattagacaaatagcccaagaaagtagtggggagattcagtatggaggtagccgacaacctgcagtcttgaggacgtttagtcagaaattgtgcagggggtttaatgatgctgtgaatggctttgtggatgacggttggtctgttctaagtagcgatggggtagaagatgtcaccattgctgtcaactcatctccaaataaatttcttggttcccaatacaatgcaaccatatttccaaattttggaagaggagtgctctgtgccaaggcgtccatgcttcttcagaatgttccgcctgctgtgcttgtacgctttctgagggaacaccgctctgagtgggctgaccatggaattgatgcatactcagctgcatctttgaaaactagttcttatgccattccatgtgtgagacctggtggtttccctagtagccatgtcattttgcctcttgcccacactgttgaaca

SEQ ID NO: 111 - DNA, 380 bp, Eucalyptus grandis
gctcttcgaacactttctccacccctacccgaaggattcggacaaagtcatgctggccaaacagacagggctcactagaagccaggtgtcgaattggtttataaatgctcgagttcggctttggaagccgatggtggaggagatgtacacggaggaaatcaaggagcaagaacagaatgggggaggagcagaggaaaaaccaagcaagagtgaacgcgaggactcagcatccaagtcctctggcctccaggacaaggcccccaactccaatgagaacagcaccaagagcttcaaaccaaaggagatcacctcgaggaaccacgacacccctgccatctctactaattcggcttcctccatcgggggaaacgtccgcagca

SEQ ID NO: 112 - DNA, 348 bp, Eucalyptus grandis
gacaaattgatgaaacatgaatatggatgggtgtttaacactccggttgatgtaaagggcctcggtttgcatgattactatagcatcataaagcatccaatggacttgggcagtgtgaagacaaggctgaaccggaactggtataagtcaccgaaagaatttgcagaggatgtcagacttacgttccgtaatgccatgacatataaccctgaagggcaagatgttcatgtcatggctgagattctgtacaagatatttgaggatagatgggccattatagagtcagattataatcgtgaaatgcggtttgcgttagactacgacatgggtcttcctacacctacctca

SEQ ID NO: 113 - DNA, 350 bp, Eucalyptus grandis
ccctcatacggaaatgggtattctcctccacaatatggcaatggacctgcatatcaccctatgccaacatactacccgatgggctacaggatctgtgctggatgcaatacagagattggtcatggacggtttttgagttgcatgaatgctgtttggcatcctgaatgtttctgctgccgtgcttgcaccctgccaatttctgattatgagttttctttatcaggcaattatccttaccataaatcttgctacaaggaacactaccacccaaagtgtgatgtctgcagtcactttatccctacaaaccttgccggtcttattgagtacagggcgcatcccttttggagtca

SEQ ID NO: 114 - DNA, 534 bp, Eucalyptus grandis
acatggccagaggatatttgctcggtcaagagcgacatgttcgattctgaaagtccgcattacactgacgctgcccactcttcgctcttagagcccggcgattcttcctatgctttcgaacctgaccattcggacctatctcaagacgaagaagataatttgagcaagagccttttgtccactcgcaattacccaaagctcgaaaactctgactacgccatcctgcctccaaattcgtgtaactttggattccatgctgaggatcctgccttttggccttggtcatactgaaggcgtccttgatgccgttcactccctttgttttcttgtatcatatatgaggggatacgctataagtatgcaataagctccatcaatagctagcatctgtccaaatgctgtagtgagctttctcaaggaagttggaacctgtgttgatttccttttctttaggttttgtccttcaatgggatcgtctgttttctatgtaaactaaataaagaaaccttgtttatcaatgcaaaaaaaaaaaaa

SEQ ID NO: 115 - DNA, 450 bp, Eucalyptus grandis
aagaaggtaaactcgggcacagcaacagtagcaatagcttggacaatgggaaatatgtgaggtacacgcctgagcaggttgaggccctcgagaggctctaccacgagtgtccgaagcccagttcactccgtcgccaacagctgatcagggagtgtcccattctctccaatattgagcccaagcaaatcaaggtctggttccagaaccgaagatgcagggagaagcagaggaaagaagcttcccgtttgcaagctgtgaacaggaagctcactgcgatgaacaagttattgatggaggagaatgataggttgcagaagcaagtttctcagctggtgtatgagaatggctatttccgccaacacacccagaacacgacgcttgcaaccaaagacacaagctgtgaatcggtggtgacgagcggtcaacaccagttgacatctcagcatcctc

SEQ ID NO: 116 - DNA, 501 bp, Eucalyptus grandis
ggaagaaaatatgcagcatttgaaggacgaagctgcgaacatgatgaagaagatcgagctcctggaagattcaagaaggaagctccttggtgaaggtctaggatcatgctcgatagaggaactgcaacagatagaacagcagctagaacggagtgttatcagcattcgtgctagaaagactcaggtcttcaaggagcagattgacaagcttaaagagaaggagaagatgttgacagctgagaatgcaatcttaactgagaagtgtggaatcaagcccccacaaagagcaaatgagtgcagggatagtccacttctcagagagagcaccccgagttcggaggtggagaccggtctcttcatcggaccaccagagaccagatcgaggcgcctgccgtttcagaattaaaaatatagccctagcctctcaaagtttcaaaatgtcacaaggcagacgggcagaaaacaaccaccgaccatggccgaagaacaccaccaccacct

SEQ ID NO: 117 - DNA, 372 bp, Eucalyptus grandis
gacaaggatccgaagagacccgtgagggacccggtcttcgccgccgtcccagataagttcgtcgcgagcatgatgaagcggtgcggcctgatcttgacgaaggttatgaagcacaagcacgggtgggtgttcaacacccccgtcgacgcggtcgggttagggcttcacgattaccaccagataatcaagaaccccatggatctcggcaccgtgaagacgaatctcgagaggaatttctaccactcgccgcaggagttcgcggccgacgtgaggctgaccttcaacaacgcattgacgtataaccctaaggggcacgacgtgcatcacatggcggagacgctgctcgtgcagttcgaccagatgttcgatcct

SEQ ID NO: 118 - DNA, 378 bp, Eucalyptus grandis
gtgagcctctcccgtgtcgagaagcacgcgtcgagcgccatgaacaagctccacgaagccgccatgaaaggcgacctcgcggccctccaagacctgctgttgcaggacccccagatcctccacaagaccacttcttcgtcctccgacggcacgcccctgcacgtttcctgcctctcgggccacgcgtccttcaccaaacacctcctcacccacaacccggagctcgccaaggaggccgactcccgcggctccctgcccctccacgtggcgtgcgcgaagggcgacgtggagatcgtcagggccctcgtggccgtcgacccggccgggtgtctccggtatgatcgcgaggggaggacgcctctgcacttggccgccatc

SEQ ID NO: 119 - DNA, 414 bp, Eucalyptus grandis
cgacgacctcgacaacgagagggcgtcctcccgcggcggcggcagcgacgaggaggacggcgacatgtcgaggaagaagctccggctgtcgaaggaccagtccgccgtcctcgaggagagcttcaaagagcacaacaccctcaatcctaagcaaaagctggcactggcgaagcagctggggctgcggcccagacaagtggaggtctggttccagaacaggcgagccaggacgaagctgaagcagacggaggtggattgcgagtacctgaagcggtgctgcgagagcctgacggaggagaaccggcggctgcagaaggaggtgcaggagctgcgggcgctcaagctctccccgcagttctacatgcaccttttcccttccaccacccttaccatgtgccccttctgtgagcgcgt

SEQ ID NO: 120 - DNA, 313 bp, Eucalyptus grandis
gccgattacgacgagggcggcgacgacaatccggggagccgccacccggtgacccggcagttcttcccggtggaggaggaggaggagctggaagaggatggcgagcgggcaggaatggggggagccgcagtgccgccggggttcccgagggcgcactgggtcggagtcaggttccgccagtcggatcaccatccaatcggatcgggcaagggctcaccgatattggagggttcacagcccatgaagaagatcaggaaagggccgaggtcgcggagctcccagtatagaggggtcactttttacaggcgaactg

SEQ ID NO: 121 - DNA, 415 bp, Eucalyptus grandis
cgacgacctcgacaacgagagggcgtcctcccgcggcggcggcagcgacgaggaggacggcgacatgtcgaggaagaagctccggctgtcgaaggaccagtccgccgtcctcgaggagagcttcaaagagcacaacaccctcaatcctaagcaaaagctggcactggcgaagcagctggggctgcggcccagacaagtggaggtctggttccagaacaggcgagccaggacgaagctgaagcagacggaggtggattgcgagtacctgaagcggtgctgcgagagcctgacggaggagaaccggcggctgcagaaggaggtgcaggagctgcgggcgctcaagctctccccgcaattctacatgcacctatcccctcccaccaccctcaccatgtgcccctcctgtgagcgcgtc

SEQ ID NO: 122 - DNA, 385 bp, Eucalyptus grandis
ggagagccagaagctcatggaggcggtccagaacggcgacgtctcggccgccgtggacctcctcgaccaagaccctctcctcctcgacaggatcatcgtcctcggcgtctccgacacgcccctccacgcggcctccgtgctcggccacgccgacctcgtccgggagctgctgcgccgcgccccccggctcgcctccgagcaggactcccggggcaactcgccgctccacctggccgccggcaagggccacggcgagatcgtgggcgagctcctgtcggccgacccggcggcggcgtcggcgcggaacctcgacgggcgggcgccgatccacgtggcggcgatcaagggccgggtcgacgcggtgggacggatggtcggggccgtc

SEQ ID NO: 123 - DNA, 282 bp, Eucalyptus grandis
gtatagcgggtatttaagtagcttgaaacaagaactctccaagaagaagaagaaaggaaaactacctaaggaagcccggcagaagctgcttagctggtgggagttacactacaaatggccatatccatcggagacagaaaaggtggcattggctgaatccactggtttagaccagaaacagataaacaattggttcataaatcatgttatagagtgttgggtaaagtccatggcaaccctaatgcaagaaatatttttgatgactaaggtcattcttaggtc

SEQ ID NO: 124 - DNA, 383 bp, Eucalyptus grandis
gcactttcagcttcggcatcctgaaggccggcgagggaggtgatggtgtcgcggacgacgaactcggggtgacgaggcagctgttcccggtgagggaggtggatgcggatatggagtggtgcggcgagtcgtcctcgcttgataagaggagcgatgtcttcttggttggtgcttgtaaggaaaaggaaggtccgaggctggcgatgccgcagcagcggaggaagagcaggaggggaccgaggtcaaggagctcgcagtatagaggggttactttttataggaggactggaagatgggagtcgcacatatgggactgtggaaaacaagtgtatttgggtggattcgacactgcacatgctgcagctagacctatgatcgagctc

SEQ ID NO: 125 - DNA, 350 bp, Eucalyptus grandis
ttccgaagatatgcagttcatggtgatggacggtcttcatcctcaaggtgccgctttatacatggatggtcactacattggtgatggtccctaccgtttgggcccgtaggctgtcaatccatgcaccataatcggatatataggtttgatgttcttgcagggtcctctggtggttgcttcgcctttacattatgtgtcctagtgtatgaattgttagttgtgccacctgatcaaatcatgttatagagtgttgggtaaagtccatggcaacccaatgcaagaaatatttttgatgactaaggtcattcttaggtcatatctatgtatcctcttatatgtcttggttttcc

SEQ ID NO: 126 - DNA, 539 bp, Eucalyptus grandis
gctgccttcgaaggcatggactcgctcccgagcccaaggaagaagaagaaccagctggtgaacagaagaaggttcagtgatgaacagatcaggtcactggagtctatctttgaatccgagtcgaggctagagcctcggaagaagctgcagctcgctagggaattggggctgcagccccgccaggtggccatttggttccagaacaagagagcccgatggaagtccaagcagctggagcgtgacttcgccattcttcgcgccaactacaacgccctctattcccggttcgagtctctcaagaaagagaagcaatccttggtcactcagattgagaaactaaaccaactcgtcgagaagccgcaaggagagggccagagctgcgggcatgatttggcaacgaacagcaccgatcgcgaatccgacaatggggttcccaagtatgaagacagtcagcctgtatttccggataaactaacgcgtttgatgggaatcccatgtgaggatgactactttggcctaaagagagcagagcctcctaa

SEQ ID NO: 127 - DNA, 493 bp, Eucalyptus grandis
taacctcacggacaagctgcttcacaagggaaatgagaaggagagttccgagtcgtccagcaaatcatctcaagggctattccagaaccccattgctgattctgtttctgaggacgaagtgtccagagtccccattcctacatggccagaggatatttgctcggtcaagagcgacatgttcgattctgaaagtccgcattacactgacgctgcccactcttcgctcttagagcccggcgattcttcctatgctttcgaacctgaccattcggacctatctcaagacgaagaagataatttgagcaagagccttttgtccactcgcaattacccaaagctcgaaaactctgactacgccatcctgcctccaaattcgtgtaactttggattccatgctgaggatcctgccttttggccttggtcatactgaaggcgtccttgatgccgttcactccctttgttttcttgtatcatatatgaggggatacgctat

SEQ ID NO: 128 - DNA, 627 bp, Eucalyptus grandis
ccgagaagaggacccccaagaagagagggaggaagccaggcctcggccgcgacacgccgctgaaccacgtggaagccgaacggcagcgccgggagaagctgaaccaccgcttctatgcgctgcgagcggtggtcccgaacgtgtccaggatggacaaggcgtccctgctctccgacgcggtgtcctacatcaacgagctcaagtccaagatcggcgatctggagtcccagttgcagagagagtccaagagggtcaaacaggaggtcaccgacgcaaccgacaacctgagcaccaccacctccgtcgaccatagtagcccatccggatgcggcggttctttgctcgaggtggaggttaagatcgtggggtgcgacgccatgataagggtccagtcggagaatgcgaactacccatcggcgaggttgatggcagcgatgcgggacctggagctccacatacaccacgccagcctgtcgacggtgaacgacctcatgctccaagacgtggtggttagtgttccggaggggctcaaaggggaggaagatctcagagctgcgcttcttcgggcactggaacaatgacggtcggagaaattgccgggggagagagagagagagtacgtactgt

SEQ ID NO: 129 - DNA, 385 bp, Eucalyptus grandis
ggaagatgacaaactagggagaaatagagcatctgcaaacgtggtacaatcatcttctgtaaaggggaggccttctggtggaactcttgttgtatgccctactagtgtgcttaggcagtggggtgatgagctgaaaaataaggtttcagagaaggctaagctatctgtatgtatgtatcatgggaccaccaggaccaaagatccatatgaattagctaattatgatgttgttctgacaacatattctatcgtaagcatggaggtaccgaaacccgctggttttaaagatgagaaggatagtctgcaagatgatgatgatgcgttttttggtaggaagagaaagcactctgctaaatctgagaaaagacgcttgaagaaagaaatg

SEQ ID NO: 130 - DNA, 345 bp, Eucalyptus grandis
tttcagattgtttatcaattggttgctagacttcaactccgcagattctgctattgatagtgcacattttcagattttgacagcatttgcgaatgcattccatgctttgcaacctctgaaagttccagcgttcagctttgcatggctcgagctggttagtcacaggagtttcatgccaaagattctctcagggaactctcagaaaggttggccttacttccagcgcctgctggttgacttgtttcagtacatggaaccattcttgaggaatgctgaacttggtttgccggttcattttctgtataagggaacacttagagtgctgcttgtgctgcttcatgattt

SEQ ID NO: 131 - DNA, 766 bp, Eucalyptus grandis
gccgtctgaggagtcttgctctctctctctctctctctctctcttcttatcttcttctcccccaaaaccccatcggacccaaaaaccctaacgaagatgaatagggagaggcttatgaagatggcgggttctgtccgcactggtggaaagggtaccatgagaagaaagaagaaggctgttcataagaccaccacgacagatgataaaaggcttcaaagcaccctgaagaggattggggtgaatgccatccccgcaattgaagaagtcaacatttttaaggatgatgtagttatccagtttttgaatcccaaagttcaagcgtctattgctgcaaatacctgggtagttagtggttctcctcagaccaagaagctacaggatatcctccctggcatcatcaaccaattaggtcctgataacttggacaacctgaggaagttggcagagcaattccagaagcaggtgcctggtgcggccactggttctggtgccactggaatgcaggatgacgacgacgacgaagtccccgagcttgtacctggcgagacttttgaggccgccgctgaagagggtcaggcgactcaggtgactgaggcgactcaggtgactgaggccactaaggtgactgaggcaactccggcctcctagagagagggattgttattgtcatttcaatacttgtagtgctattaaaatccttattttctctcatttgtctgtctttccattgtacttttaacgaactgttttaatctcgtgaggcttg

SEQ ID NO: 132 - DNA, 162 bp, Eucalyptus grandis
ggatcttgccaaaagggtgactcctgtgagtacgcgcacggcgtatttgagtcgtggcttcatcctgcacagtatagaacaagactgtgcaaggatgagactggatgtgctcgcaaagtttgtttctttgctcacaagcccgaagaattaaggcctgtctat

SEQ ID NO: 133 - DNA, 518 bp, Eucalyptus grandis
attatatcgtcgtgtctatttcccgaaatatttgcataactactagctgggtcctgtcgtaagccttacaataaatctactattagctgagtattgggtgtcgaataatttgcacgaagccacgaactattggcaatcgatctcatggcttcctcgagcggaacgtcttccgggtcaaccttgatccagaactcgggatcagaggagagtctgcaggccttgatggatcagaggaagaggaagaggatgatctccaaccgcgagtcggcgaggcggtcgcggatgaggaagcagaggcacctggacgatctgatgcttgtggtggctcagctcaggaaagacaaccagcagctaagggacaacgtgaacgtggtgaaccagcattacatgaccctggagaccgagaactccatcttgagggtccagatgaacgagctcaccaacaggctggagtctttgaaggatatactcggtatcctggatgccggagatggtggcagaccaggaaatggtggcgg

SEQ ID NO: 134 - DNA, 413 bp, Eucalyptus grandis
cctcgtcctctcccccccccaccggagcttcgaaatcgagcggcggcgacgcgatgacggacggccacctcttcaataacatctccctcggcggccgcggcggctccaaccctggacagataaagattttctcaggagggatttcatggaggagacaaggaggcggcaaagcagttgaagttgataaatctgacattgtcggggtgacctggatgaaggtgccgaggacaaatcaattaggtgtccgcaccaaagatggtttacattataagttcactggattccgagacccggatgttattagtttgaccaactttttccaaaatacctgcgggttaactccggaggagaaacagctttctgtgagtggtcggaactggggagaagttgatttgagtggtaatatgctgaca

SEQ ID NO: 135 - DNA, 278 bp, Eucalyptus grandis
agactggggcccatggggcccaaaactctctgcaatgcttgtggtatccgttacaagacaggtcgcctctttccagagtaccgtcccagtgcaagcccaacatatgtcccttctcttaacattgtatccaatgaaatcccttcaagccatttatggctttcccttcttcaaaaataaatcttttcaaccattgtcactcccacacgtatccgactcacagtaaggttgcaaaaccacgtctatgttgtccaaccttctccaaaagagtggcagagtac

SEQ ID NO: 136 - DNA, 237 bp, Eucalyptus grandis
ccggggtggcaatcgatgtgaagataatgggttgggatgaagtggttcgagtagagagcggacggaaggatcatcctgcagcaaggttaatggtggctcttcaagaattgaacttggagttgcagcatgctagtgtttctgtggtgaacgagctcatgatccagcaagccacagttaagatggggagtcagttgtacactcaggagcagctcaaggcagctctattggccgtaatct

SEQ ID NO: 137 - DNA, 371 bp, Eucalyptus grandis
ccaagccgccgatgaagaagcagaagagcaagcccgctgctgcttcggagacggccggaccggcccgacggtgcagccactgcggcgtgcagaagaccccgcagtggagggccggccccaacggggcgaagacgctgtgcaacgcgtgcggggtccggttcaagtcgggccggctgtacccggagtaccggcccgcgtgtagccccacgttttctagcgagctgcactcgaaccaccaccgcaaggtgctggagatgaggcgcaagaaggagtcaatgacgacgacggcactgggtcagcccgagcccggtcgggcccgtgcccagcttttgagggcaagggtgggttcttcctggcgccctcgggaaata

SEQ ID NO: 138 - DNA, 947 bp, Eucalyptus grandis
cagggaagacctgttccactgctaatgctgagggtcgctaagacagtggatgcttatctcggcgagatcgccacctacagtgaggtcagcattgcaaagttcaatgggattgctactatcgtgcctaaaggagcccgaaaggttgacgatgatctttatcgtgcgattgatatctacttgaagtctcacccgaacctcgatgaagatcatcgtcaacctttcgggctcctttaggccgcgggcctcctccgctgtggcaagagctgccgcctccggtggatcaattacctgcggccggacctcaagcggggcaacttcaccgaagaagaggatgagatcatcatcaaactgcacagccttcttggtaacaaatggtcgctcattgctgggcgtttgccggggagaacggacaacgagatcaagaactactggaacacgcacataaggaggaagcttttgaaccgaggcatcgatccggccactcacaggctgatcaatgagcccgcacaagatcaccatgacgagcccaccatttcttttgctgctaattctaaggagatcaaagagatgaagaacaacgcagagctcaatttcatgtgcaacttagaagagtcggcagacgtggcatcgtcggctcgagaaaggtgtcctgacctgaatctcgagctcggaatcagccctccttctcatcaactgcatcagcctgagccactcttgagattcactggtaggaaaagtgatttgtgtctggagtgtaatttggggttgaaaaatagccaaaattgcagatgcagtgttggggtgatcgagagtgaaactagtgttgggtatgacttcttgggcttgaaggcaagtgttttggattataggagctgaattttggtgaagaagatggataattgtgcagcgaagagatgaggcagagattgttattagttgaaatctgc

SEQ ID NO: 139 - DNA, 509 bp, Eucalyptus grandis
caggaatcgaaaaaaaccataaaaaaaaaaaaaaaagacgcagtttttatcgcctgtcgaacagaaaaaaccccccctccaacaacaagattttcccccttcaaaaagtcaagaatcgtttccccaccccgacagaaataaaaaagaacagaaaaaaaaacgtccagatcccatttgggagctcctcggtcgcgacccttttggtgattcctcgtgcgcccacgaagggtcctcgggtcgaatatccgcagattctgggttatcgttgtctttcggatcgggtttggtatattgggcgcattgggaggacgggaaaaattcaagaatgtccgttctgtcaaaaagcgattctgttgagattagggaggtttgggaatacaatctggaagacgagttttcgttcattcgcgaaatcgtggatgattatccctacattgccatggacaccgagttccctgggatggtccttcgaccggtggggaatttcaagagcagctccgagtctcatt

SEQ ID NO: 140 - DNA, 426 bp, Eucalyptus grandis
ccatgagaagaaagaagaaggctgttcataagaccaccacgacagatgataaaaggcttcaaagcaccctgaagaggattggggtgaatgccatccccgcaattgaagaagtcaacatttttaaggatgatgtagttatccagtttttgaatcccaaagttcaagcgtctattgctgcaaatacctgggtagttagtggttctcctcagaccaagaagctacaggatatcctccctggcatcatcaaccaattaggtcctgataacttggacaacctgggtagttagtggttctcctcagaccaagaagctacaggatatcctccctggcatcatcaaccaattaggtcctgataacttggacaacctgaggaagttggcagagcaattccagaagcaggtgcctggtgcagccactggttctggt

SEQ ID NO: 141 - DNA, 310 bp, Eucalyptus grandis
tactgggaaactctcatgttcttccaatctgaagagcttcttcacaacagctgcgtcagcgaggtgatttccagattcaatggtccgagttcgccggacgcggcggcgctgccggtagcatctaaaagcattgacctggaaagaaataggaggaagaagctcaatgaaaggctcttcgcactcagagcccttgtacccaagataagcaagatggataaggcttcgatagtgaaagatgctattgattacatccaagacttgcgtgaacaagaaggaagatccgagccgagatcgcagagctcgaatctgt

SEQ ID NO: 142 - DNA, 622 bp, Eucalyptus grandis
ccggggtggcaatcgatgtgaagataatgggttgggatgcagtggttcgagtagagagcggccggaaggatcatcctgcagcaaggttaatggtggctcttcaagaattgaacttggagttgcagcatgctagtgtttctgtggtgaacgagctcatgatccagcaagccacagttaagatggggagtcagttgtacactcaggagcagctcaaggcagctctattggccgtaatctgaggatctttgaaggatttcgttcaatgcaagttggcatcgactagacaatggaattgaagtttctccattgaaagcaagaacctgcccaatattttcaggttccgggtggtgcgaactctttgaacaatgggctttgtttagttgtgtggcttcgtctggtagattgaacccctagattgcaagttgaagtaaatacctagttctagcagatagtaattttttttccacgttgatctcctgcctgtcttcgatgtaaatagatgctccaaatttgaaactgatggggccgtttccttatcctttgttagcttgttctgccgtttgttgggttcaaccaagatcatgtctcttgtacaccaagcatcctgtaatcaatgcgcaag

SEQ ID NO: 143 - DNA, 369 bp, Eucalyptus grandis
cggaatttatagttgtcttaacttagatgctagcaatggcggaagttctgcaattgatccatctatctcaagtgccattttagacgatttttgcacaataaaggatggaccttttccgaatctttcagattgtttggtgggcaacttcagttcaagccaagatgttcagtctcagattacttctgcaagtcttgcagattctcaggctttctcaagacaagacttccctgataattcaggcggtacatcttcgagcaatgttgattttgatgagagtagcattttgaaaaacagcacatggcaacagcaagtagccccacctatgcgcacctatactaaggttcaaaaggcaggatcagtcggaaggtc

SEQ ID NO: 144 - DNA, 768 bp, Eucalyptus grandis
aagaattcgacacagtcaactttggaatagcagtgtcgagaaacagagtgttgctccctatgtgactggctaacatgtaaagcaggagattgaaggcagctccagcccaggctgtttcataaagtataccagaagttcttgtcgtttcctggtacaggggatagatcctagcaattctcggtacatattggccataaatgacgaacttcagtgactccttcgacattaaaggaacctggtacgtcatcgctgctgccgaggtacacattcgcgagaacccatctctcgttggtttccaattcgaagttcgtcgcgtcgccctctcgatctttgaggaaagcgaggacagggttgcgctctgttcgcgccatggggtcttctgcttcttcccagaggcccgacaaccttcaagacaaagttggccctgtctccgtgagtgatgaagagtggaagaaacgcctgactccggagcagtattacgttgcccggcaaaagggcactgagagggctttcactggggagtattggaacaccaagacccccggaacttatcattgcgtttgctgtgacacacctctatttgaatcaaatacaaagttcgatagtggaactgggtggccatcttactatcagcccatagggaacaatgtcaaatcaaaattggatctctcgatcattttcatgccacgccaggaagtcctgtgtgctgcttgcgacgcgcatcttggtcacatctttgatgatgggccacccccaactggtaaacgc

SEQ ID NO: 145 - DNA, 546 bp, Eucalyptus grandis
gaaagaagaagggttggtgatagaggagatagaataagaagggatggcgcagcttatggtggacaagtgcggggagggcttgctggtggcggtggaggcacagaaggcggtgccggcgccgttcctgacgaagacgtaccagctggtggatgacccctccaccgaccacatcgtctcgtggggagacgacgactccaccttcgtcgtgtggcgtccccccgagttcgcccgcgacctccttccgaactactttaagcacaataacttctccagcttcgtccgccagctcaacacctatggttttaggaagatagtaccagacaggtgggaattcgccaacgagttcttcaggaagggggagaagcatttactctgcgagattcaccgccgcaagaccgcccaaccacaactcacccaccaccacccgcactccgcctccccgcttagcggccccactccggccttcttccctttcccaagccgcctcagcatctctccctccgactccgacgaccagcattcctcccactggtgcgactcgccgcc

SEQ ID NO: 146 - DNA, 640 bp, Eucalyptus grandis
cgcggccgcgtcgacgaagaacacctcagaatcaacaccactccccaatttctctctctaagatcccacacccaaccgccaccctcaatctctctctttctctctcttcttcagtgtctgccatggctttggaggccctcagctcccccaccgctccctccgccccgttccaattcatgaaggactcctcccccgccgccgccgccgccgccgcctcctcctcctcctccgcctacgacctccccctcgccgagccctgggccaagcgcaagcgctccaagcgcccccacaacccgccctccgaggacgagtacctcgccctctgcctcatcatgctcgcccgcggcggcgccggccggaccctccccccgccgcctccccccgcggtctcttccgaggcggccaaggtggcctacaggtgccccgtctgcgacaagggcttcccctcctaccaggccctgggcggccacaaggccagccaccgcaagcacgcctcctccgccgcggccgccgccgggggtgacgaccagccgaccacctcgagcacctccgcggcgacgacctcctccggcgtctccgggaaggtccacgagtgctcgatctgccacaagagcttccccaccggccaggcgctcggcgg

SEQ ID NO: 147 - DNA, 236 bp, Eucalyptus grandis
atcagcagcagcagatggccgaggcaagagacgctcactcttcttgagatcagatctcgcctcgatcccaagttcaaggaggccaatcagaaaggacccttgtgggacgaagtctccaggataatgtctgaggaacatgggtacaatagaagcggcaagaagtgcagagagaagtttgaaaacctgtacaagtactacaagacaactaaggaaggcaaagctggaaggcaggatgg

SEQ ID NO: 148 - DNA, 520 bp, Eucalyptus grandis
ccggagccccagaggaagttcgacacttgtcatcgcccagcgcgactcgcagattcggttcgatctcggaggggaaatccaacttgcccgaaatagcaatcgcagcttgcagaatgggtcctcaaatgaacttccgaaacttggccgatgtgccagcagccgaaagaagcaccggagggcaaccaggaattcccctattatctcgacaatcctcagtatattccttgactttcaatgagtttcagaacacatggagtggactttctaaggatattggatccatcaacatggatgagttcctgaagaacatatggacagctgaggagagccaactacagctacaagacatggcgccttctggtaatggaggggaaggaggtggtcaagtagggaatttgctgagacaggggtcattgactctgtcgcggactattagtcaaaaaacagttgatgaagtgtggagagaattattcaaagagacggaggatgtgaaagaagggagtagagaaggaggtgacat

SEQ ID NO: 149 - DNA, 148 bp, Eucalyptus grandis
gacttcgagcggaaccgggcggagggggtcgactcggcccggttcgcggagctgatgatatcgtccggcctactgtgcaacgacgcggtcatctgggtcaccttccacagcgcctacgacttcgggtacctggtcaagatcctgaccc

SEQ ID NO: 150 - DNA, 443 bp, Eucalyptus grandis
cacaacacccccatatcagtaaacacttctcgctgctccagccagcttctgtctcatataaacactagccccacctcactcattatccgcttcgctcctactcaactgctatcgcgctatcccagcgcagacgtcctcccatgaacttctccgacaaggaagtgcagctcgcgtccgaccacccgaagaagcccgccgggagaaagaagttccgggagacccgccaccccgtgtaccgcggggtgcgtctgcgcgactcgggcaagtgggtctgcgaggttcgcgagcccaaaaagaagtcgaggatctggctcggcaccttccctactgtggagatggcagcgagggcgcatgacgtggcagcgctcgcgctgagaggccagtctgcctgcctcaacttcgcagactctgcgtggcggctgcccaagccggcatcgacggat

SEQ ID NO: 151 - DNA, 341 bp, Eucalyptus grandis
ggcatggacagtaggacttcgagtcgcatctctggggtgactcttcaggaggtcccgccaacttctagccaggttcctgagattccaccagctttgggggcctcagcaaatgatccctcatctgccgtatctgaactaaaggctccgtcacagggtactgctaaggtcactactaaccagtttccagatatgggtatgctcgcaggagcacaggagtctgaagcagtctccgttaatcaggcagataccgttatgactgggatctctcaaacacaagacatggtgctggaggatattgctaatatatccagagatgactacatgggagcagatctgcataa

SEQ ID NO: 152 - DNA, 603 bp, Eucalyptus grandis
gaaaagcgtacgcgaggaggcagcatgcgtggctcaccggagctaatgaggttgatagcaagactttttcgagagctattcttgcaaagagtgctcgtattcagaccgtggtttgcatccctcttctagacggcgtagtggaatttggcaccacggaaagggttcaagaggacatttcactcgtcaatcatgtcaaaaccttcttcgttgaccaccacccccctcacccaccgaaacccgccctttccgaacactcgacctccaaccccgccgccacctcgtccggccaccaccgcttccactccccgcccgtcccctcctacgccccggccgatccacccgctgcagccaaccaaggggatgaggaggaagaggacgacgacgacgacgaggaggagggagagtccgactccgaggccgagaccggccggcagggggcggcggcggcagcgcagaaccctcacggcgcagggcccgcaaacaacgccgagcccagtgagttcgagatgtctgaggacatccggctcggctcgccagacgacgggtcaaacaacctggactcggacttccccatgctgaccataaactcgacggccgcggatc

SEQ ID NO: 153 - DNA, 984 bp, Eucalyptus grandis
gggatgggtcctgtagggagccgaaagatggagaagaatccgaagcgactcgaatccttaatttgagactcgaggacgagggccagcagaggatgaggaaacgggtgctggacaagttgcacaccgtctttggtgggtcggatgaggacaattatgctctcggcttggaccgggtgacggacatggagatgttctttctggcgtccatgtacttcttgtttccctcgggagaagggggtccaggcaaatgttttgcctcggagaagcatgtatggctgacagatgcactcaagtcgtcttctgattattgcgttcggtcatttcttgcaaagtctgcagggattcggacaatagttttggttccgactgacgttggggttgtagagttgggttcggttagatctgtcccggaaagctcggagctggtgcagaccataagattgtctttctcgacgaattcatttatgtcggttaagccaatagctgccttacccatgacgaatgaaaagaaggacgaaaacgcacccttctctaatttggcgttggcaggtaagggtgaggcaatctccaagatatttggtaaggagttaaccacagttaacagtcctggccattatagggagaaacttgccgttagaaagatggactccaggcaatcgtgggaacctcaccataacggaagtaaactcccattttcaactcctagaaatggcacccaagacacgagttgggctcatcatgctcatggcgtaaagcagttgagtcctgtggaattttatggctctcaaacctcagccagtaaattagaggagcggatgaacagcggtaggaatgattttggattgaaccgctacccaacaccaaagcaggtgcaaatgcaaatcgactttacaggtgccacttcaaggccttctgtgataacccgaccattcactgccgactctgagcattctgatgttgaagcttcatgcaaggaagagcagg

SEQ ID NO: 154 - DNA, 1144 bp, Eucalyptus grandis
ccgaactggactcccatctccggcgagtgaaacgatcgaggaggaggaggaagaagcgacgatgatgatgatgacgatggccgccggcggcggcgaccaccacgcccgctccaccccgaccgtccagatcccccccgtgtgggacccgctcgacgacccggccaccggcggctgcggcgggccgtactcaccgtactccccgtactccccgtactccggcggcggcaatgccggcggggccgcgggaggaggggagtgctgcaacgacctgacggcgttgcggcggttcctgccgtcgaaccaccaccaggacgaggaggacgaggaggacgggcgggcgcccggggaggacggcgtgctgggctgcgacgagttccggatgtacgagttcaaggtgaggaagtgcgcgcgcgggaggtcgcacgactggacagagtgcccgtacgcgcaccccggcgagaaggcgcgacgcagggacccgcgccggttcttctactccggcactgcatgtcctgatttccgcaaaggcgcgtgcaagaagggtgacacgtgcgagttcgctcacggcgtgttcgagtgctggctccacccggagcgataccggacgcaggcgtgcaaggacgggcaaagctgccgccgccgcgtctgcttcttcgcccactcccccgaccagctccgggtcctccccgcccaccagcagcagcagcagcagcagcagcagcagcagcacagtcccaagagcgccaccgactccgagttcgggtccccggtccgcccctccgctgccgcggcggcggccttcgactcctacttcaccaagccgtggtcggcctccttcatatcctcgcccacctcgatcctgaccacctcgtcgcccccgatctcgcccccgaccaactcgcccccgatgtccccgaaccaacgcggcggctgctgcgggtcgcccggatcggtgagcgagctggtggcctgcatgaggaatatgcagatcgccaagatgaagatgagcccccgcgggcagatgggggggtctctcttcgggtccccgctccgacccgggtgccaccttgcggcgccggtgactcccagggccgagtcttcaccgcggtacgggcaactcggcggtggaggtggaggcgggctc

SEQ ID NO: 155 - DNA, 238 bp, Eucalyptus grandis
tattgataagatggcggaagcaccggcgagtccgatgggcggtgggagccacgagagcggcggcgagcagagcccgcagttcgggcggcgtgagggagcaggataggtacctgccgatcgcgaacatcagccgcatcatgaagaaggcgctgccggccaatgggaagatcgccaaggacgccaaggacactgtccaggagtgcgtctccgagtttatcagcttcataaccagcgaggc

SEQ ID NO: 156 - DNA, 950 bp, Eucalyptus grandis
gacgcttccctcctcccccatcccggccatggcgacccccgacgaacgcccctcctcctcctcctccgccgcctccgccgtcgccatccgccaggtctgggcctggaacctcgacgccgagttcggcctcatccgcgacctcatcgaccgctaccccttcgtctccatggacaccgagttccccggcctcgtcttccgccgccccgccggcgccggcgccggcgcccgcccctccccctccgaccactaccgcctcctcaagtccaacgtcgacgccctctccctcatccaggtcggcctcaccctctccgacgcccgcggcggcctccccgggttcatctgggagttcaacttccgggagttcgacgccgcccgcgacccccacgcgcccgactccatcgagctcctccgccgccagggcgtcgacttcgaccgcaaccgcgccgaggggatcgactccgcccgcttcgccgagctggtgatgtcgtccggcctcgtctgcaacgacgccgtcagctgggtcacgttccacagcgcctacgacttcgggtacctggtcaaggccctcacccgccgcgagctccccggcgacctcccggagttcctcgccgtcgtgcgggtgttcttcggggaccgggtgtacgacgtgaagcacctcatgcggttctgccacagcctgcacggcgggctggaccgggtcgccgccgccctggagctggaccgggcggtcggcaagtgccaccaggccggttccgacagcttgctgacgtggcaagcgttcaggaagattagggacgtctacttcgccaacgacgacgggccggagaagcacgccggcgtgttgtacggcctagaggtctattaggatcaatccccaaaattcaattcattcttttgtaccgtaccaaatttgtgggtacattttgtgaatattgttcggtatcttattc

SEQ ID NO: 157 - DNA, 272 bp, Eucalyptus grandis
gtcctgtctggaggtcttctgagctgagagatttaaaaggtctgtaaaagattcaaggtttcttctacccagaggaaagaacctacttcttcctttatcacccatgggttcttaaacctcgtgacagtgcaatttaaacattagagcaaaacataaaaaaagaagagagctgttcaaatggctactggcgtagaaggcaatgaaggtgtcccagcaaacctgagaaagcagcttgctgtggctgtgaggagtatccaatggagctacgcaat

SEQ ID NO: 158 - DNA, 863 bp, Eucalyptus grandis
ttctactccaccttcatctcacaataaaaaccagcagtccagcacgagcacattatccacttccactccagaactcaagcgcagacgtactccaatgaaccacttcttctcttcttactccgatcccagctcctgcagcctcgactttgctgaagcgtcgtcctcctcgtcgccgctgtccgatggcaggagtgctatggtgcccgggaacttttctgatgaggaggtgctcctggcgtcgcaccagccgaagaagcgcgccgggcggaagaagttccaggagacgcgccaccccgtgtaccgcggggtgcggcggcgaagctcgggcaagtgggtctgcgaggtccgcgagcccaacaagaagtcgaggatctggctgggcaccttccccaccgcggagatggctgcgagggcgcacgacgtggcggcgctcgcgctgaggggccggtccgcctgcctcaacttcgcggactccgcgtggcggctgcccgcgccggcgtcggcggacgcaaaggacatacagcaggcggcggcccaggctgcggaggcgttccggccggcggagtccgaggctgaggacgtgatgtcggggtacgagaagaagtcgccttcggaggagggaatgctgtacgacgacgaggacgtcttcgggatgccggggttactcacgaatatggcggaggggatgctcttgcctccaccacaatgcggcggagatgggtacggcggagaggacgacgggaatctggatgcatacgtgtcgttatggaactattccatgtagtcatttctcaatttcagttgtactttttgtggttagggacgactgggatgccgactaaaatatttttgaatggagtgcg

SEQ ID NO: 159 - DNA, 936 bp, Eucalyptus grandis
gggtggcttaggcttactatagagagggataggagagagagagacaggagagagagggacaggagagactttgttgttgttgttgctgctgttgttgtggtggagtgtggaggaaggaggaaggaagggaggagaaggtctcaagaggggagacatgttcagcttgatcccaacagttccattctttgcttcttccctcctgaccagatccttcaccagctgatatctgaatgagctgaggagagttcatttcttgttcactgtctacttgaatttggatcactttgtaaattgctggaattagatgcctataagaatccagaacttgccaaagaaaaatttcgatcaaggttcgagcctttcgatgcctcatgtcggggtgacttacccaccatggtggagcctgaatgaacagcaacttccgcaatctttacccaaaaatagtggcttgaaagcggaatctccacccatgctccatcatcaagcaaagcatttaggtcttcaactacaagaacaggaatcgtcttcaactcaatcggctggcaattcttgccatgaagtgagcgtcgtgggtggggccaactctcaagatcaaagcatttcatctgaatctggtcaagatgaaagttgtggcaggagctttgagggccagacaaagccaattttcatgttcaacaatccggagattgtcttcaattcttcactagctgatcaaaatcaacctctgattcgtgttccatatccaccagtcgatccttattacggtgggcttctgactgcatacagaccacaggctattattcaatcccaggtaggatctcaaatgttcgggatggcacctggacgtgttccattgccacttaaccttgcagaccatggaccaatctacgtcaatgcaaaacaatattcacggaattcttcggaggaggcagtcac

SEQ ID NO: 160 - DNA, 281 bp, Eucalyptus grandis
agggctatgggtttgttaggttcggcgatgagactgagcagttacgggccatgaccgaaatgaatggcatgtattgttcttctcgccccatgaggattgggcccgctgctaacaaaaagcctattgctacccagcaatatcagagtgcatcttaccagaacagtcaaggaaaccaaggggagaatgatccaaataatacaactatatttgtcgggggtctggatccaagtgtatcagatgaccttttgaggcaagtattcagtcaatatggagagttgcat

SEQ ID NO: 161 - DNA, 291 bp, Eucalyptus grandis
ggatacagaagaagtgccaagaaatgcaaggagaagttcgagaacgtccacaagtactataagaggaccaaggaaggccgtgctggtcgtcaagacggcaagacctacaagttcttctccgagctcgaagccctccacaacaccgccgccggggccaccgtcggaatatcaagcagcttcaagtggtggtggtgctgcttctggcactgcagccctgggcggtctctcggtacccccagtttcgatcgggatatcgttcgccaaccccgtcccaatctccactgtccgcgg

SEQ ID NO: 162 - DNA, 743 bp, Eucalyptus grandis
cctctttcccctcagcgaatggagatggaagatcaccaccagtacaccgcggcagatttgcggcacctcatcaacgcccgtccacctccacccccaccgcacatccagtcgatctccccgcctgagctattctgcggcggcggcggccaccggaacccgacgcagcacttggagtcgatgatgatgggtggcggcgggcttcacaacggccaacgccaaggccacagccacaaccatcaacaccaccaccagtttggccgtgatcattcttctccctcttcggtcgccatggctggtgcggcagggggtttagagagtgagaacggcggaaatgggagatggcctaggcaggagactctcacgctcctcgagatcaggtcgaggctcgactctaggtttaaggaggccaaccaaaagggtcctctttgggacgaagtttcaaggattatgtcggaagaacatgggtatcaacggagcggcaagaaatgcagggaaaaattcgagaacttgtacaagtattacaagaagacgaaggaaggaaaagcgggtaggcaagacggtaagcactacaggttctttcgtcagctcgaagctctctacggagagaacgccaattcgaattccatcctccaagctccatctcttccacactcactccactttcatcctccacccaacatcaatgatattaaccaagatgcgtctcatcatcgtcatcctcatcaactgcagagaccgtgcga

SEQ ID NO: 163 - DNA, 394 bp, Eucalyptus grandis
ctcaaatacacaccgacaaaaaaacaagcattgtcagaatgtcaattccaaactgattttttcggcacgagcgagtctgaatggaacgcggcgatccgaacgttgtcgccgtcgccaggctgaggagggaagactgcgaacgaaccaagcacgactccgcgttcgccacttggaaggtgctcgtaggacctactgattgggaagattattcattggggaaggaaggtgctgccaggtaccgggttcataacctcccgaaaagcccggggccggggatatatgagctcggcgtagccgcttctcatgccaaattgggtcgtgagatcgccaagctcgacccgcgatatatagtcgtggtttaccttgggaaggcggactgtgtcaggaccagact

SEQ ID NO: 164 - DNA, 1017 bp, Eucalyptus grandis
cacctctttgctctttcttccacacggtcaccactttcccctgcaactccccccttctctaaagcccttgcgtgcgagagatattccatggattagggctttccagaaagtaaaacaacctccctcagctcctcttcaccactggtttttgagatgatctgtgtgctcggcgccgttgattattatgtcttattctgacttgctgaacctgctgtttgccgtgggcgtttggtgcaccgcgtatattgcggctgccgttctcgagtcgctccgggtcttccatactctctgttcgttttgatttcgatagctgttttcgaaggctaagatgggctacgcacagctggtcatcggccctgccggcagtggcaagtcgacttattgctcgagtttgtatcaacattgtgaagctattgggcggacaatacacattgttaacctagatcctgcagcagagaactttgactatcctgtggccatggatatcagagaactcatttcattggatgatgttatggaggaacttggactaggcccaaatggtggcctcatgtactgcatggaacatcttgaggaaaacctggatgattggctcactgaggagctggataactatttggacgatgattacttagtattcgactgcccaggccagatagaacttttctcacatgtgccagtgcttcgaaattttgtggagcatttacagcgtaagaacttcaatgtctgtggggtatacttgcttgattcacagttcatcacagatgtgaccaaatttatcagtggatgcatggcatctctctctgccatggttcaactcgaattgccccatgtaaatatcctgtcaaaaatggaccttgtgaaaaacaagagagatattgatgattacttgaatccggaacctcgagtgttgttgtcagagttgaaccaaacaatggctcctaagtttgagaagctcaataaagctttggcagaactggtggatgaatatagcatggtgagcttcatacctctcga

SEQ ID NO: 165 - DNA, 376 bp, Eucalyptus grandis
tatccaaccattatttatcgtccctacagttttatggccaaaatcagcgccgtggagcgcggacattttctgacggtgatcccgcattttgcctggcgactggtgaatccggcaacgctgaaatattttgatgcaccgcacaggccgatgtatatgcaggaatatctttattcaatcagaaatcatcgttataccgccacgatgcttcagcatattgctgaagatcgtgacgggacgagtcattaacccagcatcgagccggttgcaattaaattacggtgtaagtcgaagacgtggctaagatcgtggtgaatatgtccgccaggcgcattttccagatagcgatgcagataatcccgatacataggatgtgcac

SEQ ID NO: 166 - DNA, 689 bp, Eucalyptus grandis
aaatagaagaagaagaagaagaagaagaggatgatgatgacgattgatgaggtaagagacgtcactggtcaatggtcatgcgctgaagctttctacctttaatgcaagcatcgatcgtctcggcgacgtgctctgcttcctcttcactgctggtcagttcatatgcatccacgcgtagttgtcttcaagcgacgcatgcactgattgaagcgtcctcataggcttgtgagatgatccaagacctttcactgcttgtgatactctttataaaggacgagggatggtcttgatgaatcagcccatctagagaggcttccaccatatcacagtttggacttgtgccaatgccaaaaggttcaagcataaagatgggagttccactgcaacattctagtggtatcaaacaattgaatgttcattttcaagagcgggacttgtgttctactcaatcaaccagtcaatcattcagtgaagtgcctaatataggaggaagtactgactgtagccaagccacagttttagaacagacagaacatggtgaaactgaagggcaatcagtgagaggacaagcaaaatcagccttgtcaatgggaactcaggatttagtcttccaacctttagaggtgtgcatcccactccactatgctgaaccatccttgggtggttttatgcccgctgcttatgggcca

SEQ ID NO: 167 - DNA, 1566 bp, Eucalyptus grandis
tatctctagcttagcttggagcttacctactgtactctgcttttcccccccctctctctctctctctcgctctgaacgtttttcagtcatcgagccgagctgaactcctctccccctctctctctctctctctgggtgacccttcttcccttttctctgcgcttccgtcgaagtgaaagagggcgccgaggttgtcgtccgagatgcgtcggagaaggacctctctcctgatttcatgagaccgaccaccacactatgaaagatctaagtttgaggcaatgggaagtggtgtctacacctggcaatgaaggaaagacagcgttggagagctgaagaggacgccttgttacgtgcatatgtgaaacagtatggcccaagggagtggcaccttgtgtctcagcgcatgaacactccccttaaccgtgatgccaagtcctgcttagagaggtggaagaactacctgaaaccaggtataaagaagggatccctcagtgaggaagaacagcgtcttgtcatccagcttcaggcgaaacacggcaacaaatggaagaaaattgctgctgagatcccgggccgtacggctaagagattggggaagtggtgggaggtatttaaagagaaacagcaaagggagcaaaaggagaacaaaggtgctttaccaattgacgaggggaaatacgatcatatattagaaaacttcgccgagaagctagtgaaggagcgatcgaccccagcacttctcatggccacagcaaatggtggcttcattcacaccgattcacctgctcttgctccaactcttctacctccatggctttcaaattctaatggcaccccaactctgaggcctccttcaccgtcagtaacccttagtctctcccctgcaacagttccagcatctcaaccgattccgtggctgcaggcagatagaggactcgatagtggttctctctcactgactggtttgcccaaccatggtccactccctacttcaggagaaaatatcttaatgtctgagcttgcagagtgctgcaaggaattggaagaagggcaccgtgcttgggctgcacacaagaaggaagcggcatggaggttgaaacgactggagttgcagttggagtcggagaaggcgtgcaggaggagggagaaaatggaagagatagaggcgaaaatcaacactctcagggaagagcagaaagcttctttggataagattgaaacagaatacagagagcagctggcaggattgaggaaagatgcagaatccaaggagcagaagctggctgaacagtggacggcgaagcatgttcagctctctaagttaatcgagcaaatcgggtttagaccccggattgcagatcatgacaggcagtgagagttaccgtgagtcgtagtcctttatatacacgtctctttcttgtgccaatcatgtcattcaagtctgcttattagaattccaagactcccttttcctacccaacaaacacctacctttacgtatatctcaataacattacagagcttctcatcctcagctaagtcctctgagacattttgtatggaaat

SEQ ID NO: 168 - DNA, 381 bp, Eucalyptus grandis
agggtctggattcctgttcggtcgaggagctccaacaaacagaaaaccagttggaaagaagtctaaccaagatcagggcaagaaagaaccatttaattagggagcatattgagcggctaaaagcagaggagcggaaactactggaagaaaagagaaagctacttcaagagattgaatgcggcaaaggattgaccccggtctccagcgaaccgcctcgtgaagaaatccgcgcggagtctatggatgttgagaccgagttgtttatagggccaccgaaaagatgaaccgctcagttgcccgttctgcgattgctcaaaataatgaccatagcaacggaaacgcttcttctgctgctcttttcttcttcaatcgtgaggcaag

SEQ ID NO: 169 - DNA, 331 bp, Eucalyptus grandis
ggaggatccagtgggtcggcccgagagtgccagtgagattagccaagagccgggtcaagagtttatggatgaagacgagctcttgaacatgccgaaactgctggacgacatggcggaaggaatgctggtgagcccaccgaggactcagatggcctcagagaacgactcgccggaggactcagatggtggagagagcctgtggagttatccctaattttagaaggtgagatgatcagggcttatcaattacagtagtcctcattgtagacatatacgaatacgatatccattgtatatgatcaggatttcgtcatgatggttgatcgcatcc

SEQ ID NO: 170 - DNA, 950 bp, Eucalyptus grandis
ctggtttcgactcatctctctctctctctctctctctctctctctgatgagctttctctcccttggtgcgtgatgtgtggaggcgccatcatttccgacttcgtcgaggagcggctcgaccgccgccgccccgggagctgccgccccgagaggaagctgacccctcacgagctctggtccgagctcgaccccgcctccgacctcctcagcctcgacggccccgtggcccaaggccaccccaaccctttctctctcgtcgcaaaccaactcaaccaagtgatgaagagtgaagagaagaacagtgaggaggcgggtcacggacacgtgtcggagacccagaagagccagagcaatggccggagccagagggctcgcaagaacgtgtacagagggatccggcagaggccgtggggcaagtgggccgccgagatcagggacccccacaagggcgtccgcgtctggctcggcaccttcaagaccgccgaggaggcggcgcgggcctacgacgaagccgccaagcgcatccgcggcgacaaggccaagctcaacttctccggccccccggccccggcccagccgtcagctaagaagaggtgcgtggctcctgacgagccgaaggatgaggccggagctgcaggatgtgagctgaaggagcggatcgccagcttggaatctttcctggagctggagccaaccgaggagccgctcgagccgggcaccgggccgtccccggctgatctctggatgctcgaagacctcgtcactcatcaccagcaccgtttcgataaccagcttgtttattagataataactgagtttgatcactgatcatggtactttaaactcgtgttctagctttgggatgcttaactatgccatgttttagacgtgtaagaaccgttgtgctttcgagtgccattaatacagtaccaagtatcgtaaaaaaaaaa

SEQ ID NO: 171 - DNA, 376 bp, Eucalyptus grandis
ccagcagaggctgctgcagtactggagtgacgcgctgaatctcagcccgagggggaggatgatgatgatgaatcggttggggcccgacggcaggccgatcttccggcctccgcagccgataaacaccacgaagctctatcgtggagtgaggcagcggcattggggcaagtgggttgcagagattcgcttgccgaggaaccgaacccgactctggctcggaaccttcgacacagccgaggatgcagccctggcctatgaccgcgaggcgttcaagctacgaggggagaatgccaggctcaatttccccgagcttttcctcaacaaggacaaggctgaggaatccgctggtccaagctcgtcatcttcgtcacccccc

SEQ ID NO: 172 - DNA, 427 bp, Eucalyptus grandis
tgtccataccctctgtgggacttctggttcaatataaactcctcaacccagcttcctcctattcttcatgcatcatgatccaagatatgtcacagggttttaggaagattgatactgatcgatgggagtttgcaaaccgaggttttcaggaagggaagaagcacttgctgaagaacataaggaggagacgcaaactcagcgatcataggacaacatcgagtagtaccgttgcttcggattacccagaggctggaaaggaagctgaacttgaaatgcttaagagggaccaggaagcgttgaaggccgagatcctgaaactaagagaagagcgggagaactcgcagcatgagatcaaccaggtcatcgagcggtttcgctatgccgagtgcaggtgtcggcggatgttcctcttcctctccaaagcagc

SEQ ID NO: 173 - DNA, 607 bp, Eucalyptus grandis
gaaacaccttttgaataacatctaccgacgcaaaccaatccatagccattcggggcagggtgctcggttatctgattcggagaaacagatgtacgaggaggaaatcaagagactgcgacacgagaagagctcgcttcagttggagcttcaaagatatcagggagataatcaggatgttgatttccagatacagttactacgtaagcaattccaaaatatggaacaaaaacagacgcacttgatcaccgtcttagctcaattaatgcagaagccagtatttgcttctctttttacgcagcagtcggatagccctaccaaaaagagaaggttggcggaactggatcatttacatgactcagatgacaagagtgggctagagagtttgaaattccagaaagaaaaattcaatggtgttcccttttctctactagatttggactccgttgagaaactggagcagtctttgcactttttagaaaatctccttcaaggagtcgataacacttcaggcgcagaacagcacgacttcggagcaatatcgttgccttggccggcgggtttcaccgagagaaaggaatctttggatgattctgacaggcatatccac

SEQ ID NO: 174 - DNA, 719 bp, Eucalyptus grandis
atcggattgacttgcctttgaattcctcctcctccggggaaaattccacaccgaacttccgctttgggggggccgccggaaatctagggctccgctccgccgtcctcctccgtcgtccgcaggtccatctcggtttcaaatgctgttatatttttgatccaacatattgtcggagagcaatagaatctggcgttatgcagccaaaatctaaaatttcaaacggggtagatgctcatccacatagcatccagactagtgcagtattcactgaaccctggtggcgtggctataatactatttccccagctgacccaggaagaaacgaaacccatgcgcctttaggatgcataaatggtggttcagagtccaatggtggtcaatcacagtcaaatgaggaaagggttgaggaagatgatgatgacgataatgtcaaaggatcagggaaccctgcatgttcaggagcagttggaaatcaaggacaagggcctcaaaacgggcatggtgctcccactattattacaatgcgtgatgatggccttgcacaacctccccagctagagcttgttggtcacacaatcgcatgtgcatctaatccttatcaagatccatattatggggggttgatggcacaatatgggcatcagtcaatggcttatccttttgtcggtattcctcatgctaggatgcctctgccccttgacctggcacaagaaccttgt

SEQ ID NO: 175 - DNA, 570 bp, Eucalyptus grandis
actggggccaatgagaaggattctgtgatggaaattacatttcacgtgcccaactccaacacccaatttgttggtgatgaaaatcgtcctcctgctcaggttttccgtgacagaatcatgtcagtggcagatgttggggctggaggtgaagatgctgttgttacatttgagggaattgccattcttactccaaggggtcgctacagtgttgaacttcatctgtcattcttgcgacttcaaggacaggcaaatgactttaaaattcagtacagcagtgttgttcgcttatttttgctgccaaagtctaaccaaccacatacatttgttatcatcactcttgatccaccaattcgcaaagggcaaactttgtatccgcacattgtgatgcagtttgaaaccgactatgtggttcaaagcacattgtctatgaatgatgatttatttaacaccaagtacaaggacaagctggaaccatcttataagggactcattcatgaagtgttcaccaccatcttgcggggtttatccggtgccaaagtcacgaaaccaggaaaattccgtagttctcaa

SEQ ID NO: 176 - DNA, 754 bp, Eucalyptus grandis
cttgaaacaagtggtaatcgcctggcaagggcaatctctgatgccgatacttctagtgcagcagctctaatggatatgctggagcaaatggtgtcggttatgggcgacccaattcagcgtcttggtgcttacctcttggaagggcttagggcgaaattgaaattttccgggagcataatttaccgaaagctcaagtgcgaagaacctacgagctcagaattgctgactaacatgcaggttctctatcagatctgcccctactggaagtttgcatatgtgtccacaaatgtcatcatcaccaaagccatggaaaacgaacagagaattcacattgtcgatttccagattacacagggcagccagtgggtcactttcatccaggccctcgcacagaggcctggtggcccccccctcctccgcatcactggcatcgacgattctgattcagttcatgctcgtggggcgggactggagattgtagggcagaagctttcggaaatcgcagagtcatgtaacgtgccgttcgagttccatgatgcagccgtttctttatctgaggttgagctacagaatcttatgattcggcctggggacgctttggcagtgaactgtccttacatattgcatcacatacccgatgagagtgtgagcactcagaatcaccgagaccgggtgttgagactgatcaagagtttgtcgccgagagtggtgaccctcgtggagcaagaatccaacaccaacacatcctcattct

SEQ ID NO: 177 - DNA, 525 bp, Eucalyptus grandis
ggaaattgggatgaacctacgaaggaagaagttaatgaaccagctgatatagctgaagcaaagactgtcagtgattcagaggaagcaaaacctaatgctaagagaaaacagcctgagaaggaagcttctgagaaggaagcttcaaagaaggaaccaaacaaaccacccaatagttggtttgatttgaaggttaacacacatgtgtatgtaactgggttgcctgaggatgtcactatggaggaagtggtggaggttttttccaagtgtggaatattaaaggaggatcctgaaacaaaaaagcctcgtgtgaagatctatgttgacaaagaaactggaagaaaaaagggagatgcacttgtcacttatttaaaggagccctcagttgccctagctatccaaatattggatggagcaccttttcgccctggtggcaaggtaccgatgtcggttagccaagctaagtttgagcagaaaggtgataaatttatttctaaacaagtggacggcaagaagaaaagaaactga

SEQ ID NO: 178 - DNA, 978 bp, Eucalyptus grandis
ggccatgatgaaaacggtcatggactggaaaatggcttcacgccagtagttgagagcgatgctgaacacacttagccagaagatgttcaaaggcaaaccttcttctctcagaggctaaaagatgttccacccatggcttcttaatctgatccagatgaaccatggagaaacaaaatcgaagtctcatcaaaagggtatttgggaaggaggcattatacaaaatcattgcattggtttgctactgcagggacataaatgctgtggttatattatttagcatgcgccgtttctctgtaattacgagctgccttttgttcatgctagacttttgaacaactgcttttgcctttcctatatgaactacagatcctgattgacctaagtaatgacaaggcaaccgttcttacggacaaaatccaggtgctgaaggatttaactacggaagttaacaaattgaaagctgaatgtgcagctcttattgaagaatctcgtgaggagaagaatgagctcagagaagagaaatcatctttaaaatctgaggttgaaaatcttaatgtccagtaccagcaaaggacgagggttatgtacccttgggctgccatggatccatccgtcgtcatgggtccagcctactcatatccaggtccaatacccgtcactccaggtccaatacccatgctctcacaacttcagcctttccctttctttggaaatcagaatgcaagtgctattcctgctccgtgttctacctttatcccaaattcaatgcctgccaatcccacatttgaacagcagtcaacccaatatgcttccacttctcacgtgtcaaataaaaaagactccaaaagcaggtcttcagatcatcaaaggggcagcattgcagagcaagacgaagattcaaataacgtggcaacagaccttgaacttaagatgcctggaacatcatcacatcaggacttgacgtccggagaaaagaag

SEQ ID NO: 179 - DNA, 566 bp, Eucalyptus grandis
catcctatgaagccggaatctgttgaagtactgaatttcggagatagtgggagcggaaggttgctttcgagtcattcacaggtcgcagttgcagaggagcctctgaaccacgtcgaggcggagaggcagaggagggagaagcttaatcagaggttttacgccctcagggccgtggttccaaatgtatcaaagatggataaggcttcactgctccaagatgcggagtcttatatcagggagcttaacatgaacctacaagctgcagagtctgataaggaggatttgaagaagcagttggatgaactaaagaagcgatcatcggataaagaatgtatcccggtggatcaagatcgcaagatggcaaaacctacgggaagtaggtccactggggtggcaatcgatgtgaagataatgggttgggatgcagtggttcgagtagagagcggccggaaggatcatcctgcagcaaggttaatggtggctcttcaagaattgaacttggagttgcagcatgctagtgtttctgtggtgaacgagctcatgatccagcaagccacagttaagat

SEQ ID NO: 180 - DNA, 521 bp, Eucalyptus grandis
gcaacttttcgagctccgtcaggaggaaaaaaaaataataaaaaaaagagatgatgctcggagagcctcaccgtcctcctaatccgacgatcgacgttcctccctggccgatcctggacgatccgacggacgacgccgtgcctcactctccgtactccccttacacgctcaatgctggctacggcggcggctgcgactcctctccctccgccgccggccccggccacttccaggacgtcatggcggcgctccggcggttcctgccgtcgaaccgccccgacacggacccggacccggatatgacgtcctcccgcgaggcggacttccccatggacgtctactcctgcgacaacttccgcatgtacgagttcaaggtgaggcggtgcgcgcgggggcggtcgcacgactggacggagtgcccgtacgcccatcccggcgagaaggcccgccggcgggacccgcggaagtaccactactccggcaccgcgtgcccggagttccggaaggggagctgccggaag

SEQ ID NO: 181 - DNA, 449 bp, Eucalyptus grandis
ccgacgagccctccacctccgccaccaactccggcggcggggcggccgccgcgagctcgagcgggggcgggaggtcgcacgagtgctccatatgccacaagtccttccccaccggccaggccctgggcgggcacaagcgttgccactacgatggcggcgccagcggctccgccaacagcggggtcaccacgtccgagggcgtggggtccgcggccccgcccgcgctcggatacgacagcggccgccgcaacttcgacctgaacgtgcccgcgctgccggagttcccgaccgggttcatcgtgtcgggcgacgacgaggtggagagcccccacccctcgaagaagccgcgcttctcgacgcccctgaagatcaagctctctccagaacagtgaaatctttgcctgtgcttttaggattagcgcttgttaattgatttagctagggctttt

SEQ ID NO: 182 - DNA, 610 bp, Eucalyptus grandis
ctctctcttctttctctctcttctgcgtgcgcgatcgccattgaagaagctctgcgcgagacctcggaaggcggaggaggaatccccccacgcgatttcgcatccgccgccgccgccgccggccgccgctttccgttcttattgcaattctcaagatagatccatggcattcgagcagtactttgcccaggagtggaggcccatccctggaccagctatggattctggaagtagcgatggctgtttcgactgcaacatctgtctagactttgcgattgagcctgtggtcactctctgtggtcacctctactgctggccctgcatctacaaatggctccacgtgcaaagcgcctcgcttgcttctgatgagcacccacagtgtcccgtctgcaaggctgaaatatcccacacagccatggtccctctctatggccgtggccaaagctccaaagagtctgatctgcaagacaaggcactccaactaggaacaattgtacccccgagaccagcggcttgtggcatccaagctctcgcctctacaacaccccgcagcggtcagcagctcccctaccgtaatccttaccaaaatccgtactacagcgccaattcg

SEQ ID NO: 183 - DNA, 767 bp, Eucalyptus grandis
cccgactcagcaagcaaaagaagaaaccagaaaaatcagacaccccgatttcacattctctactacagacttccagagatggtgaagagagacagagaggacacggaggtcgaagccctggccagggccaattgcttgatgctcctctcccgagttggcgagagcaccgactcggcgtcgccggaccgcaaatcgcggcctaccgagcgaatgttcgcgtgcaagacttgcaaccgcgagttctcctcgttccaggcgctcggagggcacaaagccagccacaagaagccgaagctgatctccggcgacctcttccacctcggccacgcagcagattcctcgccggccaagccgaagacgcacgagtgctcgatatgcggcctcgatttcccgatgggccaagccctcggcggtcacatgaggaggcacagggcggccatgctggaaagcttggcagcagcagccgcaaagcctgtgccagtgttgaagaaatcaaacagcaagagagtcacgggcttggatttgaactcgttgccgatggaggacgacttgaccttgcgcttaggaaaggttgcgccgccattggtgctagatctcgttttgtaggagcttagagagcgtagattgtgtacaaagcagtttttagtcggtgcctggccatttctttttctttttttttccttcttttttgaattcattgattgatattttgaatcagagactgggtttcgcatggatattaatttgtttccaaaaaaaaaaaaaaa

SEQ ID NO: 184 - DNA, 469 bp, Eucalyptus grandis
catgacccgacgccgccggcgaacgactgggtcatggagaccaggaagaaccactcggtgtcggcggcgtcgggttgcccggtcgggcctacttcagctcgaatcccgcgtgggtcacgggggccgagaggttggggaattgcgggtgcgatagggcccggcaggcgcagatcttcgggttgcagaccatcgcgtgcgtccctgttttgaacggtgtggtcgaactgggttccaccgagccgatctaccagagctccgatctgattagcggaattagggggctgttcaatttccatgaatcggagatgggatgcggtggtagggttttgaatagcgagcatgacccggcgtcgctttggatctgcgatccgccagtcacgatggagattaacgatcgtcctatgacatttcagatagagaaccccagctcgagcagtcttaccgaaagccccagcgcgatctgcgcgat

SEQ ID NO: 185 - DNA, 533 bp, Eucalyptus grandis
gccttggcacgcaaattccatcgggaatccatatgccttctgcgaatcttagttccatatcgatcttgggtcctattcccatggtatcgggggatggtggtgggaggaccggttctgagcggtcaagaaacgctgattgtgctccggcaggttttcctggaggtgatgaagatgtgaataagggaggggacattccttatggaatgtcaaccatcgtgagagtcattcccaattctaggtacttgagggtggcgcagcaactgcttgatgaaatagtgaatgtgcgaaaggctttgaagcgccctgatgacgcgaatgaccaatctagacatgagaaccaaaggagccccaaagatgcggatgggggttccaagaacgaagcatcctcaaatccccaagaatccgccagtaactctagcgagctttctgctgctgaaaaacaagatttgcagaacaagctcacgaagctcttgtccatgttggacgaggttgataaaaggtacaagcagtactatcaccaaatgcagatcgtg

SEQ ID NO: 186 - DNA, 413 bp, Eucalyptus grandis
ggacggctcaagaagacaggatcctcaccaactacatcaaggctcacggcgagggcaggtggaggaacctccccaagaaagcaggtccctagcgtttgccagtgtgtttttccttttgttttctgcctttgaatgagcttgtggagatagcgggagagatcgagactcgtccgggcggttcgattctcgagagataatcgtcgtcgttcgctagggaaacgaggtttcgtctgactacggatggaaattcctttttgcagggttgcagagatgtggcaagagttgcaggctgcgatggttgaactacctgaggcctgacatcaaaagaggcaacatatctcccgatgaggaagagctcatcatcaggcttcacaagcttttggggaacaggtgaaacttcttctgttctgacc

SEQ ID NO: 187 - DNA, 574 bp, Eucalyptus grandis
tcgaactttatcgcgatctcgccgccatctcgtgccagcctgcaccagatgcatcacccgccgaacccggattctctctcgctgcttcaatccgcgcgaaccccaaatgcacctccggagcatcccgttccctccacttccaggagggatgaagttgctgtgttgaaaagtcagaaggcaggccgtgagaaattgaggagggatcgactgaacgagcactttatcgagttgggaaatacgctagatcctgataggccaaaaaatgacaaagcgacaattttatcagatactgtacaactgctgaaggatttaactgctcaggtgaaccaactcaaagctgaatatagtacgttctgtgaagaatctcgtgagttgacacaggagaaaaatgatctcaaagaagaaaaggcctctctaaaatctgacatcgagagccttaatgctcagtatcagcagagagctagagccatgtttccatggcccattatggatcactcagtggttatggccccaccttcatacccatatccagtgcccgtagctgtgccttctggtcccattcctgttcatccac

SEQ ID NO: 188 - DNA, 988 bp, Eucalyptus grandis
gggcgccgtctggctagcgagggcgagctctcttatcttcttcttcctcctgctccacctaaaaccctcgcccggcaaaaccgattcgaggtcgagagtcgagtaaagatgaatgtggagaagcttatgaagatggcgggttcagtccgcactggtggaaagggtaccatgagaagaaagaagaaggctgtgcacaagacaactaccacggatgacaaaaggctccaaagcactctcaaaagaattggggttaatgctattcctgcaattgaggaagtcaacattttcaaggatgatgttgtcatccaatttgtaaatcccaaagttcaagcctctattgcagccaatacatgggttgtcagtggtgctcctcagaccaagaaattgcaagatatcctcccaggaataatcaaccaattagggccagataacttggacaacctaaggaagctggctgaacagttccagaagcagtcacctggtgctgctgccacagcaggcgcaactgcaatgcaggaggatgatgatgatgaggtccctgaacttgttccgggggagactttcgaggctgctgcggaggagggtcacaaatcttagagactctacatggattttgtgcctttccatatatatttcgtggtgtttaaaattttgccttcttctcttcgcccttcttactttcacattttgatgaagtgttctgtgattgtcatctcatgatcctgtgacacactaattagctaagttactggaaactctagttcaaagctactctcttttatctttaaaaaaaaaaaaaaaaaactcggcaacttcgatcctccttagttttcgacttcaattcgcctttaccgtaaatctgagaatgtcttgctgcggaggaagctgtggctgcggctctggctgcaagtgcggcagcggctgcggagggtgcaagatgcatgccgacctgacctacaacgccgagagcatcaccgccgctgagacc

SEQ ID NO: 189 - DNA, 536 bp, Eucalyptus grandis
ctccatttcaaattacagacgagaggctctctcaccttctccgtcgctctgaaaccccacgccctacagaccttctactacaatgggggaacccatctttctccccggccggacgagtctcgtcggctcgatcagtgtcaacgtagttggaatccaacacaatgccggcaccttcagagcgggcgagacagtggcacttgtccgcgagccgtccaacactgatgatgagatggccatccaagtcctcaacacgaggggcatggtggtcggctacatcaagcgcgaagctgccaaagtcttggccccactaatagactctcagctgatctccgtctacgccattgtgcccaaagttcctagggtcgagaagctgtttttcatcaattgccaagtgcgagtattagcgagggatgatgacttcgagcacgtgaagtcaacgatcttggaaggcaagttgatgctcaccccgccggtggggaaggaggtgagaggcgtgaacgagagtttcacgttggtcggccagggtgtcgagaaga

SEQ ID NO: 190 - DNA, 2444 bp, Eucalyptus grandis
ctctcctctttcctctctctcctttctctctctctctctctctcgaggataaacagaggacgcgaaaaggaattgactcggggggtgggagtcgcgccaggagcttcttccctgcgctgagatctgatgctctgatttctccagtgtaacgggaacccagcaaatccagcaacctcgtgcgtcggagtcggtgttcaccgcttgttttcggattccgatcttataagtttgtgagggttttgtggttttttcgtggaagatctatatcagaaaatgatgatgttcgaggatatgggaatctgtggcgatctggacttcttctctgcccctctcggggagggacatggggttgctccgcaaactgagccagaggccaccgtggaggatgattattccgatgaagagatcgatgtggatgagctcgagagaaggatgtggagggacaagatgcgtctcaagcggctaaaggagcagaacaaggggaaggagggagttgatatcgcgaaacagcggcagtcccaagagcaggcaaggaggaagaagatgtcgagagctcaggatggaattcttaagtacatgttgaagatgatggaggtctgtaaggctcagggttttgtgtatggaatcatcccagaaaagggaaagccggttaccggggcatcagacaatctaagagaatggtggaaggacaaagtcaggttcgatcgaaacggtccagccgccatagccaagtaccaagccgatcattccgttcctgggaagaatgatggatgcaaccccatcggacctaccccgcacactctgcaagagcttcaggacacgacccttggctcgcttctgtcagcactcatgcagcactgtgacccccctcagaggcggttcccattggagaaaggcgttcctcctccatggtggcccactggaaacgaggactggtggccccagctgggtttgccgaaggatcaaggagccccgccctacaagaaacctcatgatcttaagaaggcatggaaggtaggtgttctcacggcggtgatcaagcacatgtctcctgatatcgccaagatacgcaagctcgtgaggcagtccaaatgcttgcaagataagatgacggccaaggaaagtgctacttggctggctataataaaccaagaggagtctttggcacgagagctttaccctgattcatgcctcccactgtcctcatctggagggagcgggtctttggtcataaatgactgcagtgagtatgatgtcgaagggatggaagacgagcccaactatgatgtacaagagcgcaagcctgagaatctcaacccaccatcccatctggggctggagagaatgagaggtccttttgtccagcaatcgcctttccaaatgaagggagaagttgtcagcaacttagatatggcgcggaagaggaagccgtgcaatgatttgaatatggtgatggatcacaagattttcacctgtgagttcctgcagtgcccttatagtgaactgaggctggggttccgtgacagaacctcaagggacaatcaccagctgagctgcccttacagaagcaattcttcagagtttggcgggtcaaacttccatgttaatgaggtcaagccagtgattttccctcaaggttttgtccagtccaagcccatgacttcaacggtcaattcagcatcaaccccctttgatctatcagggcttggagttcctgaagatgggcagaaagtgatatctgatcttatgtcgatctacgataccagcatccaaggcaacaagaacatgaatcccgcgaatgatgcgatcatagaagaccagagccgtcctcagccaaagcttcaacaacaaaacgagtttgtgggatcattctttcagcaacccaatgcttccgccaatcatcacatgttctcccgagaggacattcagttcgaccggttcaagaccatgaattcttcgttcgaggccaacaaccacaaccacgacaacctacagctcatgttcgggtctccattcgatttgtcgtctttcgattttaaggaggagttgccaggtggggtcatggatcccctgccgaagcaggatgtcactatatggttccagcaatgatttctgcgtgctcagcttctcgggcgttcttgggaactgtatatttctctgaagagagatctatatacttaactgtggtctcttgttagatcgagtttaagttttcttggccaaggtctttgcttagcttatgtattctctcgaactttgttaggtgtagatttagaaagtttaggcaggggtttagatggggaaataagatattagacaaggacccatgactagccctgcttgctgctgaatatataaaaatgttgtctgatcaagtgattattctactagactgtcctataaataagtgaggtgcgttttcttttaaaaaaaaaaaaaaaaaa

SEQ ID NO: 191 - DNA, 473 bp, Eucalyptus grandis
cagcaagcaaaagaggaaaccagaaaaaagcagacacctcggtttcacgttctctactacagaattccggagatggtgaagagagacagagaggacacggaggtcgaagccctggccctggccaactgcttgatgctcctctcccgagtcggcaagagcaccgactcgccatggctgaaccacaaatcccggcctacggagcggatgttcgcgtgcaagacgtgcaaccgcgagttttcatccttccaggcactcggagggcacagagccagccacaagaagccgaagctgtccggcgatctcttccacctagggcgctccgcggattcctcaccggccaagccgaagacgcacgagtgcgcgatatgcggcctcgagttcccgcttggccaagcccttggcggtcacatgaggaggcacagggccgccatggcggagagcttggcgacggccgaaaagcctgtgccggtgtt

SEQ ID NO: 192 - DNA, 468 bp, Eucalyptus grandis
caaaaaagttacggttggattgcggtaaagaaatggtgatggatatttcaaatgacgaccgctatcttaatgaagagattggtggtccgaaggatgcacttgatgatggaactcagcctaataacaagaggaagcgcggtagagcaccaaagagggctatgaaggctgaaagggaaaagttaaagcgtgatcatctgaatgagcttttcgacaaactgggtagtcttcttgaattgagtgagccgaacaacgggaaggcctctataataaatgagactatccggcttttaaaggatatgatttctcagattcaaagtctaagaaaggagaacacgactttgttgtccgaatctcattatgttgcagcagaaactaatgagctgaaagacgagaattttgcactcgaagctcaaatcaagaatgtacaaagggaattagaagacaagttaggccattctaagcccgacc

SEQ ID NO: 193 - DNA, 968 bp, Eucalyptus grandis
gagtgtctgccacttctagatatgacccagcagcctccttggcaggaattggttgcaactgatctacatggcaatgaatggcatttccgacatatttttcgagggcaacctagacgccacctactcactactggatggagtgtctttgtgagctccaagaagttgatagctggtgatgcctttatatttttgaggggtgaagatggagaattgcgcgtcggtgttaggagattaatgagacagcaaagtaacatgccatcctctgttatatctagtcacagcatgcatcttggggttctggccactgcatctcatgccattgcaactggaactctcttttctgtattctacaaaccaagaacaagtaggtcagagttcattgtgagtctcaataaataccttgaagcacgggcccacaagctatccattggaatgaggtttaaaatgaaatttgagggtgaagaagtttcagaaagaaggttcagcggcacaatcattggtgtaggagacagcatgtcatctggatggactaattctgaatggagatccttaaaggtccaatgggacgaaccttcatcaatcatgcgtcccgacagagtttcatcatgggaattggagccacttgttgtgactgctccttctaattcccaacaggtacagaggaagcgagcacggccaactgttttaccatcatcatcagtgcaagaactttctgcgttcggtggacctaaagctcctgagtattcttcagattttctacatggcgattcccagaggggaagagatgtctatctctctcccaagttttctccatctgctaggtcaaaatctttaaattacaatggaaatggttcaccagctgcattatctggctacacagtcaactggcctagtcatatggaaactattactgatccatgtacaccagtcaatgggaaagaatctagtgaaaagagagagagcggtgg

SEQ ID NO: 194 - DNA, 345 bp, Eucalyptus grandis
cggccgcctgcagctttcccctccgtgtcgacacgacgacgactccgccgccgctcccccctcgcgtcgtctctccttctctcgccctgtatatatctctcgtcccccgacaaaaaaaggagaaatctgaagagaggggactgaaattaggttattgagaaggattcttcccgtgaccaatcttttggagaaagatggcttctcaatttaatttcaaaggcataaccgatgcatcgcaagctgaaggagtagctgggaaatcacacggaaatcactctttaactcggcagccatcaatatatgctttgacttttgatgagtttcaaaacacatggggtgggcttg

SEQ ID NO: 195 - DNA, 456 bp, Eucalyptus grandis
gagacttcccctagctcatcttcactcaccaccaccaccgcccccgcccccgccgccgccgccgccgccgcaaccacctcatcctcctcctattcctccgccgtggcggtcgccgcgacaacagcaacaacctcctcctcctccacctcctcgaccgggtcggatccggcgctagaaccgagcaaaagaagcgaggattgcacttctcaaaagggcccggggaagtccccgagcccgggcgcccacccggaggagccggccggcaagaggcacaaggccgggggctccggcgagcacccgacgtaccgtggggtccgaatgcggaactggggcaagtgggtgtccgagatccgggagccgaggaagaagtcgagaatctggctcgggacgtaccccacggcggagatggccgcccgggcccacgacgtggcggcattggccataaagggcagcttc

SEQ ID NO: 196 - DNA, 569 bp, Eucalyptus grandis
aaaagcagaaaaagaaaaaagagagcaaaaaaaaggcaatcgagagcagcttctccatttcctttcttctcttccgctcgatccatttcgaaatccgcagagaattgtcgagaagagacgagacgatgttcccgagacccaaagtcgacccggcctccgccggaaccgtcgtgatccgcgaggtgtgggcccacaacctcgagtccgagttcgacctcatccgcgacgtcgtcgacacccaccccttcatctccatggacaccgagttcccgggcgtcgtcttccggccccctcctcccccctccgccggcgggcactaccgccgcctccgcccctccgaccactaccgcctcctcaagtccaacgtcgacgccctcagcctcatccaggtcggcctcaccttctccgaccccgacgggaacctccccgacctcggctgccccggcggcccccgctacatctgggagttcaacttccgggacttcgacgtcgcccgcgacgcccacgccccggactccatcgagctcctccgccgccaggggatcgacttcgagcggaaccgggcggag

SEQ ID NO: 197 - DNA, 1007 bp, Eucalyptus grandis
ggaaaccatctgaaaggcgtggtgggcctcggggtcctttccgtggaagtggaggtcgccgtggcggttttaacaatggagaagctggcgagggggagcgtccaagaagaacatttgaacgccgcagtggcactggacgaggaaacgagtttaaacgagatggagctggtcgtggaaactggggaactcctactgatgaaattgctccggagcctgaagaacctgttgtggaagttgaaaaaaatgtgggatctgagaagcagttggttgatgaggaggctgcagatgctagcaaagagaatcctttgaatgaaccagaggaaaaagagcctgaagataaggagatgacattagaagagtatgaaaaggtccgcgaagagaagaggaaggcattgcttgcattgaaggctgaggaaaggaaagtggaggtggacaaagagttgaagtccatgcaacaactctctagcaagaaggaaaaccatgacatctttatcaagctgggatccgagaaggacaaacgcaaagaggctgctgagaaagaagagagagccgagaagtctgtcagcataaatgagtttctaaagcctgctgaaggggagagatactacaacccaggtggccgtgggcgaggccgtggccgcggtgccagaggtggttatggtggtggaggtggtggtggctatggtagagatgcagctgctccttcgattaaggatcctggccagttcccctcccttggtgggaaatgaggttttaccactgcatacttcaagctgagttacttcatgcttggagttgttgtgatcttccaggataatcagttattaacgggaattacatttttcctgtaacagaaacctttgatattattcagtcttttttgagtgtaaattttagtttctccatggatttactttgcttttcttttgactcacttcagttttgattgtgttagaagagaatgaattaagccttttctaaaaaaaaaaaaaaaaaaaaaaaaaaaa

SEQ ID NO: 198 - DNA, 390 bp, Eucalyptus grandis
cccatttcttccttggctccgttctgttgcttcctctctctgtcttcgacacttcagctcgtgcgagcccaaaaatcgatccttttctgcttccttttgcctctgttccagctgtggtcgagtaagcaggagtcaattgatactgggtcgatctggtcggcaacttttgttggaagtttgaggaatctgattgagagaagaggtagatctaaaggatcaaaaggatgtcatttaccggcacccaagttaaatgcaaggcttgcgaaaagacagtttatcctgttgaacagttatctgcggatggggttgcataccacaagtcttgcttcaagtgcagccactgcaaaggcacattaaaggtgtgccaattttttcaattggtttacaatc

SEQ ID NO: 199 - DNA, 586 bp, Eucalyptus grandis
tgctttcctcctactctgtcactctcactctcactctcactcctcctcttggctctccctcaccatcttcccaggtcccgcgccgcggtatcgctgccccgaccattctcgccgtctgctcaataataatcggagcaaagatgattgatctcaacacggtggaggacgacgaaacgccgtcgtccggctcctcccctgcctcttctctgtcctctgccataagcgcttcgaatattaactccaaccctgcgtacccaacttcgtcttcttcttcttcgtcctcgtgctctcccttgtgcttggagctgtggcacgcctgtgccgggcctctgatttcgcttcccaagaggggctctctggtggtctacttccctcagggccacttggagcacgtctctgattttcccacttccgtgtttgatctcccttcccaaattttctgtcgtgttgttgatgtgaagctccatgccgatgcgagcaccgacgacgtttatgcgcaggtttccctggttcctgaaagagagcaaattgagcataaattgcgcgaaggggacaacgaaatagacttggatgaggatgaaattga

SEQ ID NO: 200 - DNA, 619 bp, Eucalyptus grandis
cagaagcgaccattaacgctgtctctctctctttctctctcctcctcctcctcctcctcctcctcctcgctttttcttgaaacaatcgataatccttccttccatctttcctcctcctcccccccttgaaatcccgaatccaccaccacaaccccccaccgccacctgctcgttgggtaatctctcttttgcttctggagagggaagtgaagtgatctcggatcagctgactttggagaatgatcctaaagctggtatttctacattgagatcatctttaagagcgctgtggttctctgatggcatctcatccatcaaatcattcgtgtgggcgccctcatcaaggtgcgtttgctgatgctttatacaaagagctgtggcatgcctgtgctgggcctcttgtcacccttcctcgagagggagagcgtgtctattattttccacaaggtcacatggagcagcttgaagcatcaacaaacagagggttggaacagcaaatgccttctttcgatctgccctctaaaattctttgcagggtagtcaatattcagctccgggccgaacctgaaacagatgaagtttattcacagataactttgctacctgaacctgaacaaaa

SEQ ID NO: 201 - DNA, 376 bp, Eucalyptus grandis
tttaatggccttgacgcaggggaggggagattttctgaacttggggagatggtagaatagctgccgaggtgtcaactcatgtcagaattctgactgatctggggatcttgctctcaaagaggatttctaagagcagtatctcaacttggcatacgttcagcaactggaaaatagtaggttcaggcttatgcaactggaacaggagcttcaacgagcacgccagcagggtatatttgttagttctggaaatcctggggatctcagtcataacatggctgccattggcaatggggccatggcctttgacaccgactatgcccggtggctcgatgagcatcaacggctgatcaatgacctaagatccggagtgaacttc

SEQ ID NO: 202 - DNA, 743 bp, Eucalyptus grandis
ttttttttttgtatataatctctttatttctagttagggaaaattcagaaagaagccgtgaaggaacttcatccaatggcgatggaaaatctgaagtgcaaggaaaggttgctggggaggtggatgctgcttctgagaatgtgtccggtggagccatcgaacgtcccagagccacaggaaaattggctgcgcctgtaaactcgcccagcatgtcctcatcattggacctgaagaattcttgcatggatgcaaatgccaaccctgtgagcattttgcaacctggtgtagtgccacctgaagcctggttacagaatgaaagagaactgaaaagggagaggaggaaacagtcgaaccgtgaatctgctagaagatcaagactgaggaagcaggctgagactgaagaacttgccaaaaaggtggattctctgagtgccgagaatagggctcttaaatctgaaattagtcaactaaccgagaactcggataaattgaggctagaaaatgccacattgatggaaagactggaaaatgcacagggagtggaaaaggcggttgaatcactgggtaaattcaacgacaatgggcttctctcggacaaaacagagaacttactttcaagggtaaacaactctggtgccgttgatcgaagaagtgaagatgagggagaaatttatgaaaggaagtcgaattccggtgccaagcttcaccaacttttggattcaaaacccagaaccgatgcggtg

SEQ ID NO: 203 - DNA, 435 bp, Eucalyptus grandis
ttttctctctcgccccaccacctgaagatggaggtcgctccacaggcggagcatcaccagaaccaccaccaccaccaccaccagtatcaccaccagccgcagcaaggggaaccgggaagctactttctctcggctcctcctccgccaccacactatagcagctctggcctgtgttatggtggtggcgttggagacaacaacaatggtgggtaccttcactctcctctttctgtcatgccgctcaagtccgatgggtctctctgcatcatggaagcactcacaagatccagaccccaaggattaggtcaaggttcaacgccgaagctggaggactttttgggtggtgcaagtgcaacagtgacagcaacgacaatgcctctcagcttggacagcttgtatagctaccaacagagtgccgacccagagaaacagtcg

SEQ ID NO: 204 - DNA, 662 bp, Eucalyptus grandis
gcgaaacgcagagagagaaagtagagagagagagagagacaagtattccctctcagtcaccccagccgacgatcctcccgccgaccgcctcctcccccggccgttccgatcctcccggcgacgcgacgacaatggtgaagccgagcggcggcggcggcgatcgggcccccccgctggcgccgttcctcagcaagtgctacgagatggtggaggacgaggcgaccgaccccatcatcgcgtgggggagcgccggcgacaccttcgtcatctgggacatcactcaattcaccctccagttgctcccccactacttcaagcactccaacttctccagcttcatgcgccagctcaacatctacggtttcagaaaagttgattcagatcgttgggaattcgcaaatgatggattcatcagaggtcaaaagcatatgttgaagaatatacgcaggaggaagaatgttcaggttgtggatcagaaaaaatcattgcagaagcaggataattccgttgaagaagtcgataaaattaaaatagatgggctttggaaagaagttgaaaatttgaagattgataagacagtcctttcgctggagttaggtaaagttagacagctccaggaaacttcagataataaattggtcctcctgagagaccgtgttcag

SEQ ID NO: 205 - DNA, 694 bp, Eucalyptus grandis
aaagtcccgagatgccgcgacgcgaattcccctctcgaatgcgctcggaattcgagcgatgatcggagcggcgaccaaccagatcccgccgccgccgccgccgccgcagccgcagcaagccgcgcccgccgccgccgcgatccggttccccgactccgtctacaacgcgctcagggtgggcgccgtcttccagcggctgtcgaagcacctcgccaccatcggcaagggctccggcctgtcggcatcttgcggtacttccatggagttcctgaactcgtgcctctgcctcgccagaggcattgactatgcggtcgcgaacaatgaggttctgcccaaagctcacgaattgcctgtcttattgaaaaggctctgccttcttaaagatgatagtttctatctttcagttataatggttctgatgatctctgttaagaatgcatgcaaatataaatggttttcagagaaggattgccaagagctccttgcccttgttgatgaaattgggaaaaactttcaaagtccaagagacgctgccgttggaagtactgcctctttttcccgagtttcaagtatatttgcaagattctatccacagctgaagatgggctacgatcttatttcgctggaagtagagcctggatatgcagcactggtcaatgattttcacatatctaagagcatggtgcactctcca

SEQ ID NO: 206 - DNA, 1210 bp, Eucalyptus grandis
ggaggaggaggtgaggaggaaatgaagggaaaagagggggagagaaaaggaattcaggcacggcaacaactggaaaggaacggggttcaaaggttctctctcttttaagcagtgagtgagggggtgcaaattctcattccaaccatgattctgtcttgagctcgtggggggtgagggagagggagacgtctccagctcgagtcgtcatctgggtccgcgtcttctcttcccttcttccaatggtttgatcctaggacagagagagaaagagagagatatacaaaaagagagatacagagagatagagggagagggagagggagagggagactcgtggcgctgtttcgagctttctagcttccggaggaggagggctggtgttgagcgaaacttggagaggtcatgaattcgacaaccactcagtttgtgtcctctagaaggatggggatgtatgacccgattcaccaaattggaatgtgggacgagaacttcaagcagaatggaaatcctaatgcgccgccagctctgatcatacctatgcacgcgaatttggacaaccagtcggaggatacttctcatggatcacaggatactgctggcaagtatgagcaagaaacatcgaaaccttatgataaggtgcaaagacgtcttgcccaaaaccgtgaggctgcgcgcaaaagccgtctgcggaaaaaggcttatgttcagcagctagaagcaagtcgtttgaagcttatgcagttagaacaagaggttgaccgagctagacaacagggtgtgtacatggcttcaggagtagattcagcttatccaggatatggtggatgtttaaattcaggaatcgttgcatttgagatggagtacgggcactggattgatgaacagaatagacaaatatgtgagctgagggctgctttgaatgatcatagaactgacgtagagcttcgcatcctcgtggaaagtggcatgaaccactatttggaactttttcgcatgaaagcggttgcctcaaaggccgatgttttctatgtgatgtccggaatgtggaggacatcgtcagagcgattcttcctgtggatcgggggatttcgtccttcagaacttcttaaggttctcatgcctcagctcgaccccttgtcagaccaacaatgggcgtttgtttccaacctcaggcaagcttgtcaacaggctgaagatgccctaaagcaag

SEQ ID NO: 207 - DNA, 438 bp, Eucalyptus grandis
aatcaacaccactccccaatttctctctctaagatcccaccccaaccgccaccctcaatctctctctttctctctcttcttcagtgtctgccccgtctgcgacaagggcttcccctcctaccaggccctgggcggccacaaggccagccaccgcaagcacgcctcctccgccgcggccgccgccgggggtgacgaccagccgaccacctcgagcacctccgcggcgacgacctcctccggcgtctccgggaaggtccacgagtgctcgatctgccacaagagcttccccaccggccaggcgctcggcgggcacaagcggtgccactacgaggcccccgcccccatccccgcctccttctccgccccctccgccgccgccgccccggccgccagcggggtgagcgtgtcggagggcgtggggtccacgcacacgcagag

SEQ ID NO: 208 - DNA, 516 bp, Eucalyptus grandis
agacatcacaaaattcagcagctacaacgagctcggagtgagcttgctcgcatgtttagccttgaaggccagttggaggaccctgtgagatcaggctggcagcttgtattcgtagatagggagaatgatagtcttctccttggtgatggcccttggccggagtttgtgaacagtgtgtggtgcatcaagatactctcacctcaagaagtccagcaaatgggcaaacaagatctggagcttctgaattccatccctgttcaaaggcactcgaacggcggttgcgatgaattcacaaaccgacaggattctagaaccattaactccggaataccatctgtggggtctcttgattatggaactctatgacctgttaagatgcaatttcttgctgtaatattcagtgttgtccaagccatccgtggttggaacgactcgcttagttcttaccttagattgtaacactcatgcagaatttagcactgtaatgatatttgcttctctcccaaaaaaaaaaaa

SEQ ID NO: 209 - DNA, 547 bp, Eucalyptus grandis
aaccgacgacacaggtgacaagaatcacaggttcgaagggggtcaattgggtgttgcagcagcttctgattccagtgacagatcaaaagaaaaagccacagatcagaagactttacgcaggcttgctcaaaaccgtgaagctgccagaaagagtagattaaggaaaaaggcatatgtccaacaactggagagtagcaggctgaaactcacccaactagagcaagaactgcagcgagcccgtcagcagggcattttcatttcaggtagtggagaacaatcccactcaatgagcggaaatggtgccctggcctttgatgttgaatatgcacgttggcttgaagagcacaacaaggttgttaatgagctgagaaatgcggtcaatgctcatgctggggacactgagctacggacaattgttgacaatgtcgccgcacactttgatgaaatcttcaagctgaaaggcactgcagcaaaagctgatgttttccacattttgtctggaatgtggaaaactccagcagagcgatgctttatgtggattggtggg

SEQ ID NO: 210 - DNA, 522 bp, Eucalyptus grandis
aaaagagcgaccattctctctctctctctctctctctgtgaagatcctctctagcgataaatcactgttgcccatttcttccttggctccgttctgttgcttcctctctctgtcttcgacacttcagctcgtgcgagcccaaaaatcgatccttttctgcttccttttgcctctgttccagtacagctgtggtcgagtaagcaggagtcaattgatactgggtcgatctggtcggcaacttttgttggaagtttgaggaatctgattgagagaagaggtagatctaaaggatcaaaaggatgtcatttaccggcacccaagttaaatgcaaggcttgcgaaaagacagtttatcctgttgaacagttatctgcggatggggttgcataccacaagtcttgcttcaagtgcagccactgcaaaggcacattaaagctgagcagctactcctcaatggaaggagttctatactgcaagcctcactttgagcagcttttcaaggagactggtaatttcaacaaga

SEQ ID NO: 211 - DNA, 1160 bp, Eucalyptus grandis
ggattctgaaggcagagctcttgaggagctgggggtagatgagaatgatatcggaggatctcctccaagatcaactcctcacatgttctgtaagacactcacagcttctgatactagcaccccggagggttttctgtcccacgtcgagcagctgaagattgctttccccctctggactataagcagcaaaggccttctcaggaacttgtcgccaaggatttgcatggagtcgaatggaggtttcgccatatttatagaggtcagccaagaaggcatctgcttaccacaggatggagtgtttttgtgagccaaaagcgtttttcatgtattctacagtccaagggcaagccatgcagagtttgtcgttccctatcagaagtatctcaaaagcatcaacaacgtgatatgcattgggacaaggttcaaaatgagagttgacgtagatgatgcaccagaaaagaggtgtactggtgtagtgactaggataggcgacttggatccttataggtggcccaactcaaaatggagatgcctgatggttcaatgggatgatgatatcacgaatgggcatcaagatcgggtctcaccctgggaaattgatccatctgtttctcactcacctttgagcattcagtcctctccaaggcttaaaaggccgcggactagtctgccaacaatgccgcctgtccctggtggaggggtcaggcttttggactttgaggaatctttacgatcctctaaggtcttgcaaggtcaagaaaagttgcatttggtgtcacctgtctatggacgtgacaccctaaactgtcaggtcgatttcgaacaatcccctgcacatcagggtctagcatctgttgtaagtaagaaaaggccaacaatatcaatgagtacatgagggctaatgcccctagttatgcaggctttgtggaatccgatagattcccaagggtcttgcaaggtcaagaaatatgcacactgaagtctttgacgactaaacctgagtacaacctagggacctgggggaaatccagtctttcgtgcagttctttcggtgtgcatcaggcacccaagtaccatttcgaccaagtgaaatcatccgaaagccttcagaaagtgtactttccatataatgacattcttaaatccagccaagatcgcac

SEQ ID NO: 212 - DNA, 850 bp, Eucalyptus grandis
ttcgacgggcaaatcgtccccagactgttatgccttcttcagttctatcaagtgacagcatgcatattggccttcttgcagcagcagctcatgctgctgccacgaacagccgctttacaatcttttacaatccaagggccagtccatcggagtttgtcatacctctggcaaaatatgtgaaagcagtctatcacacaagggtatctgttggcatgcgattcagaatgctttttgagacagaagagtcaagcgttcgtagatacatggggacgataacaggcattagtgatctggatcctgttcgctggcaaaactcacattggcgttcagtaaaggttggatgggatgagtcaactgcaggtgagaggcagccaagagtatccttgtgggaaattgagccactaacaacattcccaatgtatccttctccattccccctcagactgaagagaccatggccatctggacttccttcatttcatgcccttagggatggtgatatgagtatcagttcttcactgatgtggcttcaaggtgttggggatcagggagttcagtcgttaaacttccagggatttgggatgactccatggctccagccaagatatgacacttcaatggctgctttacaaactgatgtgtatcaggcaatggcaagcgcagcactgcaggatatgagggcagtggacccttcaaaatgtgcatctcagtctcttctgcctcttcagcaatctcaaaatgttcctatggggcaagcttctatcatccagaggcagatgttgcagcagtctcaatctcaaaatagccttcttcagggcttccaggaaaatcaggcaaaacccaaaggcag

SEQ ID NO: 213 - DNA, 534 bp, Eucalyptus grandis
ggacaagctgagggagatagaaaattcattgtttggacctgaatctgatatcagtgatagctgcaattgttgcctaaatagtgggagccaccaattcccgtcaactgggcagtggaatgtaaaccagatgatagagatgatccctaaattggatttgaaggacatgctgattgtctgtgcacaagcagttgccgaagctgacatgcctaggacagctgctttgatggaggtgttagagaggatggtgtctgtctcaggagatccaatccaacggttgggtgcttacttattagaagggcttagagcgaggttggaatcatctgggagcataatctacagaaagctcaagtgcaaagagcccactggctcggaattgatgtcttacatgtccatcctctatcaaatttgtccatactggaagtttgcctacgagtcggcaaatgttgtaattggggaagctataaagtacgagtcaagaatccacataattgacttccagatcgctcaaggaagccagtggatccctattatcca

SEQ ID NO: 214 - DNA, 358 bp, Eucalyptus grandis
ctcctctcctccctcactctccctcttatctcctccctcctctcctccgggtacatgcaagaattcgagggggagagagggagagagcgtgctttgaacatggggaggagcccgaggtgcgacaaggacgggctcaacaaaggagcgtggacggccgcggaggaccagatcctgatggactacgtcaagctccacggcgagggcaaatggagccggctctccagggaaaccggtctaagaagatgcggcaagagctgcaggctgcgttggatgaattacctgaggcccgacatcaagagagggaacatctcgcccgacgaagaagaactaatcatccggcttcacaagctattgggca

SEQ ID NO: 215 - DNA, 988 bp, Eucalyptus grandis
actcccctcgccccccctacatcatccctcctcgctccttccgtcctttctctctcctctgcttcttcttcttcttcttcttctccttcttcttctttctctctctagctctctcgctctggcccacgcggctgctcctccttcctgctctctcccccccatcgcggccgagcttaatgtgagctcagcttcgagatctgcgtagattagggttttttcgcgagccgagcccgccatgcgcccggccctgtccgcggggcccgccgcctgaatgcgctcgccgcctgctcggtggagccgacgccgcgcgcgggggggtcgagggggaggggaggaagatctagcgggagcctgctacgatggttagggatttcgtctactgtatcggcatcgatttcggttgaggcttttcgtttcctcttcttttctgttggggggtggggggtgggggcgcgcgagggaccggtttccgccccggcaatggatgcgtccgcgtaggaggcgcggtccgtgcgaggggaggagggcggtttgcgcgggggggttttgggagttgaagacgggaagaaagtggagcttgtgctgaagaatgagactctcgtcgtcgggcttcaaccatcagtcgccggaagcctcaaatgcaggggagaagaaatgtttgaactctgagctatggcatgcatgtgctggtcctcttgtgtcgttgcctcctgttggaagcagagtcgtctactttcctcaaggacatagtgagcaggtggctgcttctactaataaggaagtagatgctcatatcccgaattatccaaacttatccccacagcttatctgtcagcttcataatgttaccatgcacgcggatgtggagacggatgaagtgtatgctcaaatgaccctgcagcctctaagtccgcaagagcaaaaggatctatatctactgcctgctgaacttggaactcccagtaaacagccaacaaactacttctgc

SEQ ID NO: 216 - DNA, 669 bp, Eucalyptus grandis
cttctcccttcctttccttgaccacgtcgtcgtcctcctctcctccgcgtcgcaaaatccgaaccctaggccgcgcagcgaaccgccggaatccatcgcccgcggaggtcgccgccgccgccgtacatgcttatttatcgcgccgccgccccgccgagcgtattctccttcgatcgggccctatgagccccgcgcgatcgaagccgatcgcgatccgggccgtcttctacgccaacctcgagtccgagttcgcgctgatccggtccgtcgtcgaccggttcccgatcatctccatggacaccgagttccccggcaccgtgatccgccccggccccgccggcgggggcggcggccgagcgctgccgccgccggagagcaactacggcctcctcaaggcgaacgtcgaccggatgcacatgatccagatcgggctcacgctgtcggacggcgagggcaacctccccgacttcggcaccaagtgcgcgtacatctgggagttcaattttagggatttcgacgcggcgcgcgacgtgcagaacccggactcggtggcgttgctccggaagcaggggatcgatttcgagatgaacaggcagaagggcgccgactcggcccggttcggcgagctgctgatgtcgtcggggctcgtctgcaacgatgaagtgagtt

SEQ ID NO: 217 - DNA, 334 bp, Eucalyptus grandis
ccgtggcggttttaacatggagaagctggcgagggggagcgtccaagaagaacatttgaacgccgcagtggcactggacgagggttggtattgtacaccaagaatgttgcattttagctttgaaaacgagtttaaacgagatggagctggtcgtggaaactggggaactcctactgatgaaattgctccggagcctgaagaacctgttgtggaagttgaaaaaaatgtgggatctgagaagcagttggttgatgaggaggctgcagatgctagcaaagagaatcctttgaatgaaccagaggaaaaagagcctgaagataaggagatgacatta

SEQ ID NO: 218 - DNA, 478 bp, Eucalyptus grandis
cagtcgggtttgccgttagatgataggcccgagggagctcgctccccttctccggaacctatatatgataatatggggattaggatcaatacgagagagtatcgtgctcgtgagcgtctgaacaaggagagacaggacattattacacagattattaagcggaatccagcgtttaagcccccggctgattataggcctcccaagctacagaagaagctgtacataccgatgaaagagtaccccggttacaattttattggacttataataggacctaggggcaatacccagaaaaggatggaacgtgaaactggtgcaaagatcgtcattcgtggaaaaggttcagtgaaagagggtaggttgcagcagaagagggatttgaagcctgatccagcagagaatgaggatttgcatgttttggtggaagcggagacacaggaggcactagatgcagctgcagggatggtggagaaactgt

SEQ ID NO: 219 - DNA, 1677 bp, Eucalyptus grandis
ccgttccttccccgttccttccctgatcttccgtcgtccggcggttccccgttccggctccagcaatgtgtgggggcgccatcatctccgacttcatccccaaccagagggcccgccgattgacctcggacttcctgtggcccgatctgaagagatcggccggcaagcagtcgaggcggccggccaggtcggaggtcgtcgatgtcgtggacgatgacttcgaggccgacttccagggcttcaaggacgagtccgacgtcgaggacgacttcgacgacgaggtcgaggtcgacgtcaagcccttcgctttctccgccgccgagcctcggtactccaaaggctcttcgaccaccaaatctgtggagtataatgggcaagctgagaaatctgccaagagaaagaggaagaaccaatataggggaatcaggcagcgtccatggggaaaatgggctgctgagatccgtgacccaaggaaaggggtccgagtttggcttgggacgtttaacacagcagaagaagctgcccgagcttatgatgctgaggctcggagaattcgtggcaagaaagctaaagtgaacttccctgatgattcttccagtgcatcatcaaaacgctctgtgaagtcaaatgttcagaaacttcccaagacaacaacaaacaacgtgcagcctaatctgaatcaaaatttcaattatgcaaacagctctgatgatgacatttacagttccatgggttttgttgaagaaaaaccacctactaaccagttttacatggatgctttgaatgcccaaggggtttctggaatgaattctctttcccctgctgacaatgcccccttgtacttcaattcagaccagggaagcaactcatttgagtgttctgactttggttggggtgaaaatgccccaagaactccagatgtctcatctgtactttcagctaccctggaagttgatgaatctcagtttgaggatgctaacccaaggaagaaaatcaggtctgcttctgatgatgtgtccgaggaagaaaacaccgctgcaaagacattctctgaggagctgtctgcttttgagtccgatatgaagttcttccagatgccatttgtggatggtggctgggatccgtcagtggaagccttacttggtggagaggcaactcaggatggtggaaatgcagtggatctctggagctttgatgacctcgctcccatgatggggggagtcttctaaaagagttaccgttggctggtttttttatgtaaataaggctacatgttagtgagtcctcgactgtctgcctgtcttattatattgagttgttttccgatgttaaaaagtcctagtcaatgagaaagagagattgcttcctaatatgctgcaatgctttcaggaatgatttgtctactgtggtggtggagtaccaaacgtttgaacatggttaagccttggatgaagtgtggtttcccagtcagatatgtggtatattggagtatgctgctgactaggttaagttttaaagtccagaccttcttattggaattttgaacttacgtctgtaatttgatgattatgtgtgataaatgctgaaactctgatgacagcaatagcttgttctgttggccagtgcttctctcaataattgccagggcctgtgataaattgtggcaaaaaaaaaaaa

SEQ ID NO: 220 - DNA, 916 bp, Eucalyptus grandis
cacggcggcgccgccgggtttcttgggccgagggccgtgccgatgaaacaggcaggtctcgcccagaagcccacgaagctgtaccggggagtgaggcagaggcactgggggaagtgggtggccgagatccggctacccaagaaccgcacccgcctctggctcggcaccttcgacacagccgaggaggccgccctcgcctacgacaaggcggcgtaccggctgcggggcgacttcgcgcggctcaacttcccgcacctcaagcacaaggggtcgcacatccagggcgacttcggcgactacaagccgctccattcctccgtggacgccaagctccaggccatctgccaggacatggccgagaagccagccgacggcaagaagaggcgctcggcccccgccggcggcggcagctccgcagctgccgcctcgccgcggaggccggagccggagccggagccggtgaagacggaggtgggagtgtcggcggcgacgtcgtcctccccggagagcgacgacgcgtcggtggaggagtcgtcgccgctgtcggagctgacgttcaacgacttcgtggagccgcagtgggagagcgtgggggtgcccgagaacttctcactgcagaagtacccgtccgagatcgactgggctgctatctattcttgaagccttttttcacttctcatcatcatcatgtcatgtccagttttctccagtagtttcgtcttctttctctttcgaatttccaagaagcgcagtatgtaatatgttaggagtaatttagggaaagcagggggctctgctgcgatggagtttttggcagttgcagcggccactgctaagccttgtatcgtcgtgtaaatccgaccacggtcccgccggggttttaagtcggcggcgccggggatcatctcatgcattc

SEQ ID NO: 221 - DNA, 567 bp, Eucalyptus grandis
gcgttgatctgctcctgatcatggccctgatcgtatggaacgagcatgttcaatctctggcaattctccatgaaactgttagcatttccgctatgaccaccgtcgatggccatcccgtatggaccgcagaagccatggaagccgggcatttccttggataaacctgtctcctccttgggattcttttcttttctcagaccagttaactcagctaaaatgtcgtgtattatattgtgatgtgagaaattacttctaatttgtattatcaccatcttcttctgtagccacactatgaaagatctaagtttgaggcaatgggaagtggtgtctacacctggcaatgaaggaaagacagcgttggagagctgaagaggacgccttgttacgtgcatatgtgaaacagtatggcccaagggagtggcaccttgtgtctcagcgcatgaacactccccttaaccgtgatgccaagtcctgcttagagaggtggaagaactacctgaaaccaggtataaagaagggatccctcagtgaggaagaacagcgtcttgtcttccatttgttgccgtg

SEQ ID NO: 222 - DNA, 985 bp, Eucalyptus grandis
gtggttttgccgtcctcggggatggtgaaatcgagcggaggcgcgggggattctgatcattcagatcttgaagcgtccgtcgtgaaggaagctgatagtagcagagtcgttgagccggagaaaaggccgcgaaagcgaggtaggaaacctgccaatggccgagaggagccattgaatcatgttgaggccgagaggcagaggagggagaagcttaaccagcggttttacgcgctccgggccgtggttcctaatgtttccaagatggacaaagcgtcacttcttggcgatgcgatagcgtacatcaaggagctgaactcgaagctccagaccacggaatctgacaaggagaatctgcagaagcaaatggaatccttgaagaaggaattaacgaataaagactctcggtctgctctgccccagagcgataaagatctcagtatctcgagcaatcacggtgccaagttgatagaattggacgtggacgtgaagataatcggatgggatgtgatgatacggattcaaagcagcaagaagaaccaccctgctgcgaagctaatgcaggccctaatggagttggatcttgacgtgcatcatgccagcgtctccgtggtgaatgacttgatgatccaacaggcgactgtgaagatgagtggtcgtttttactcacaggaacagctaaggctggcgttgtcgtccaaaataggataagcccatcagaagtagaagagggagtgatggtaattaaactgtataaaagagcttgccgatgtttgaattgtcgacgcgaataatcaggggctgggatattttaaggctcccggcacagcaagttctgaagcaagagctgccatatgctgtttgttcctcttgtagttcttagtgtagcctgctagtgtttcttattaggtactttcgattgtggagcactgagaggatatgaaacaaggtggaattgttgttgaagataaaaaaaaaaaaaaaaaaa

SEQ ID NO: 223 - DNA, 335 bp, Eucalyptus grandis
tggagcttaaacctgataagattggtttacagaggagtgagcaattaagagatctttacgagtcgctgcttgaaggggaaactgatgcacaaaacaagcggccctcggctgcattatctccagaggatctcacagacgaagagtggtattacttggtttgcatgtcctttgtattcaatcctggcgaaggtcttccgggaagagcgctagcggatggccaaactatctggttatgcaatgctcaatatgcagatagcaaagtgttttctcgctcactacttgcaaagagtgcatctattcagactgtggtatgttttccctatctcggaggtgtg

SEQ ID NO: 224 - DNA, 377 bp, Eucalyptus grandis
ccaatcttcactccccctatcccctctctctctctctcaagaactaagagcttactatggaaagcgaacgctacgatgagacgacagagaagcagcgaatcaggagaaggccgcaccagaagccgtacaggggtatccggatgaggaagtggggtaagtgggtggctgagatcagggagcccaacaagcgctcccgtatctggctcggctcctacgccaccgccgtggctgccgcccgcgcctacgacaccgctgtgttctacctccgtggcccctctgcccgcctcaacttccccgacctcatcttgcacgagggccaggactcgctgggtgaggtctcagccgcctccatccgcaggcgtgcagctgaggtcggg

SEQ ID NO: 225 - DNA, 394 bp, Eucalyptus grandis
ctcaatctgacttgtcaggggtgggatagcaagaaaagggtctgaaagtttttcttgctgaatcttctttgaccctcggacaatcagacacagcatagatttaatctgcccgaggaaacacaaaagatggctttcactggaaccgtggataaatgtaaggtttgtgacaagaccgttcatgtcgtcgacatgatgactcttgaaggcattccctatcacaaaacctgcttcagatgcagccattgcaatgggacgcttgtgatgagcaactattcctcgatggatggtgttctctactgtaagacgcatttcgagcaactcttcaaggaatccggtgatttcaggaagaatttccattcagccaagtccgacaagccgaatgagatgacaagaa

SEQ ID NO: 226 - DNA, 340 bp, Eucalyptus grandis
gactccccctatcccctctctttctccctctcaagaatcaagagattactatggaaagcgaacgctacgatgagacgacagaggggcagcgaatcaagagaaggccgcaccagcagcagcagcagcagcagcagcggcggcagaagccttacaggggtatccggatgaggaagtggggcaagtgggtggccgagatcagggagcccaacaagcgctcccgcatctggctcggctcctatgccacccccgtggccgccgcccgcgcctacgacaccgccgtcttctacctccgcggcccctccgcccgcctcaacttccccgacctcatctggcgcgaggg

SEQ ID NO: 227 - DNA, 571 bp, Eucalyptus grandis
ccgactcagcaaagccaaagaaagaaaccagaaacagcagaccagaccattccattccattccatttcgcattctctactacagactcgcagagatggtgaagagagacagagaggacgcggaggtcgaagccctggccgtggccaactgcttgatgctcctcccccgagtcggcgagagcgccgtctcgaaccgcgaatcgcggtctacagagcggatgttcgcgtgcaagacgtgcaaccgcgagttctcctcattccaggcgctcggagggcatagaaccagccacaagaagcagaagctgatccccggcggcctcttccacctcggctgcaccgcggattcctcgccagccaagccgaagaggcacgagtgctcgatatgcggcctcgagttcccgatgggccaagcccttggcggtcacatgaggaggcacagggccgccatggcggagggcttggcggcagaggcggcgaagcctgtgccggtgttgaagagatcgaatagcaagagagtcatgtgcttggatttgaactcgtcgctgatggaggacgacttgaccttgcgttta

SEQ ID NO: 228 - DNA, 726 bp, Eucalyptus grandis
atgaggactccctggacaaggaaccccctcctccgcctcctccgagattcaaggtgcattctttctgcaagaccttgactgcctcggacaccagcactcatggtggattctcagtgttgagacgtcatgcggacgaatgcctcccgcaactggacatgtcaaaacaacctcctacgcaagaactagccgccaaggatctgcatgggaatgaatggcgttttcgacatattttccgaggccagccaaggaggcacctactgcaaagtggttggagtgtttttgtgagctccaaaagacttgtcgctggggatgcatttatattcctaaggggcgaaaatggggaacttcgtgtaggtgttagacgagctatgaaacagcaaggcaacgtttcgccatcagtcatatctagtcacagcatgcatcttggtgtccttgctacggcatggcatgccatttctacaggaaccatgttcactgtttactacaaacctaggataagccctgctgagttcatcatcccttatgatcagtacatggagtctctcaagaagaattactccattggcatgagattcaaaatgagatttgaaggggaagaagctccagagcagaggtttactggaacaataatcggcattgaagatgctgacccaaaagggtggcgagatacaaaatggaggagtctcaaggtgagatgggatgagaattctgccatacctcgtccag

SEQ ID NO: 229 - DNA, 752 bp, Eucalyptus grandis
gttcagaggggtgcggaagaggaagtggggcaggtgggtctccgagatccgcctgcccaacagccgggagaggatctggctcggctcctacgacacccccgagaaggcggcccgcgccttcgacgccgccgccttctgcctcggccgccccgccgcgaagctcaacttccccggcagccccccggagatctccggcgcggcgtccctctcccccgatgagatccagtcggccgcggcgagccacgccaactttggggccgtggccgtgccggcccgggccgagctgccccgaccaggatcgccggccccgtcgccttcgctgtcggcctcggaggcgagcagcgtgctgacgaccgagagcgacctgaccctggacctatcgttcctggattttctggatgattcgggcccggtttccggcgagccccatatcgggaagttcccgggcgtggaggaggctcccgacgttttctaccacatgcagttcccgagcgtggagagcgcggggctgaatctcgatactctattggcttcagacagcttcccgtggcgtatctgaagtggactgaaggaagaagcctggccgatcatttctctcttttttttttctttttttttctataattcttttgatggactagattttgtggggtcgtcatccacttcaggataatacagatgacaagaactgactttttatggtgtaaaaagacgtagcttttttgttggttcggttcaaaaaaaaaaaaaaa

SEQ ID NO: 230 - DNA, 563 bp, Eucalyptus grandis
ccgaggccgacttcctggccaaacactccaagcccgagatcgtcgacatgctgcgcaagcacacgtaccgcgacgagctagagcagagcaagcggagctacaggggctccgccgcggaacgggccgggaggggcgggttcgggccggggcggacagagtggtcggccgccgcccgggagcagctgttcgagaaggccgtgacgccgagcgacgtggggaagctgaaccggctggtgatcccgaagcagcacgcggagaagcacttcccgctgccgggcgggccggcggcgacgatgaagggcgtactgctcaacttcgaggacgtcggcgggaaggtgtggcggttccggtattcgtactggaacagcagccagagctacgtgctcaccaagggttggagccggttcgtgaaggagaagagcctgaaggccggcgacaccgtctgcttccagcggtcgaccgggccggacaagcagctctacatcgacttcaagccgcggggccagccgccggccggcccggccgcgccgccgccgccgcccgtacagatggtgaggctgttc

SEQ ID NO: 231 - DNA, 642 bp, Eucalyptus grandis
agtaaacccaccgaccagaacctttgtgaaggttcacaaatcggggacctttgggcggtcactggatatttcaaaattcagcagctatgatgagctgcgcagtgaactcgctcgcatgtttggccttgaaggccaattggaggaccctcagagatcaggctggcagcttgtatttgtagaccgggagaatgatatccttctcctgggtgacgacccttggcaggagttcgtcaacaatgtgtggtacatcaagattctttcccctcatgaagtaaaacaactgggcaaacaaggcatcaaccctgcaaattctgtcccaaggcaggctctctgagtgcatcacggtatttgatgagcatgtttggtcgacagagttgaccgatctgagctttggggtaggcagatgatgggggtcgctggactacttgaagccgagtcgtttggtgtaagaaacggacttggcttctgatagtgtttgaccgtgttgtagtgggtacctatgagaaaaaagagttgtagtaatatattgcttcgagagatgtagtgacgtggtaagtctatctcaagtttgctttataactgtaaagtttaacaccacggatgattgaagagaatgacatcgacattcccgtaaaaaaaaaa

SEQ ID NO: 232 - DNA, 1358 bp, Eucalyptus grandis
cgatttacccccctccctctctcggcatataaaacccgcaggtgaaacccgctctctctcccccacgccttccgcccgactcggactcggactcggccgagtcaacccacgccccccgcgagtcccgaccccccggcgccatgacgcggcgatgctcccactgctgcaacaagggccacaactccaggacctgccccgtccgcggcggcggcggggacggcgggggcgcggcggccgccccctcctcctcctccccctccacctcctcctctggcgccgcggcggcggcggcggcctcggcctccggcggcggggtgaagctgttcggggttaggttaacggacgggtcgatcatgaagaagagcgccagcgtggggtgcctgtccgccgcccactaccactcctcgtcctccgccgcggcatccccgaaccccggctcgtccccgatcgacgggagcgacggctacctgtccgacgatcccgcgcccggctcccgctcgtccaatcggcgcgtcgagaggaagaaaggtaacccatggacggaggaagagcatcgaaggtttttaattggtctccagaaattgggtaaaggagactggcgagggatagctcgtgactttgtgactacaaggactcctactcaagtggcaagccatgcccagaagtattatatccggcagagtaatgctggccgaagaaagaggcgctccagcctttttgacatggctccagatatggctactgctgaccaaccctcacatccagaagaaacatttctgcctcctttggtcagacttaacgatgatactaactcaacaacttcaaccagtatgggactcgatttggaaagaacgcctatggagacctcgcacccagaaacatctgaagggggcggtgatgttgcgatggaatcaattgatcaagtacctcttgtaccctgttacttcccatactatttaccactaccctttcccatgtggccgcccaacatggcgcctcctgaagatggaagggtggtggagacatctcatcaccgtgtgctaaagccaatcccagtaattccaaaagaacccctaaatatcgaccaaatagttggaatgtctcagctaagtcttgctgagaatgaacctgcaccactctctttgaagtttctcggggaaacatctcgacagtcagcatttatcaaggcgccttcttcagtcaatgaatcggatctcgacaactgcaaggatggcgccactcaagcagcttgactcgtgcctaagatcagcgacggtttagttcttgtgaatctttctgtaaaaccatctgtattggtgtcctccttttcctgttgtatctgctttctttaggctttc

SEQ ID NO: 233 - DNA, 506 bp, Eucalyptus grandis
aaataactacctacctttttctaagaactttggctttctttcggaacaggtgaaaagaagagtataaattcagagttatggcatgcttgtgcggggccattggtgtctttgcctccagttgggagtctcgtggtctactttccccaaggccacagtgagcaagttgcagcatcaatgcagaaggagactacttgtgtacccagctaccccaatctgcccgcaaagttgatatgcatgcttcacaatgtgacattgcatgctgatctcgaaactgatgaagtctatgcacaaatgacccttcaacctgtaagcaaatatgaccaggaggcgttactggcatctgatatgggcctcaagcaaagcaggcagcctacagagtttttctgcaagacgcttacggctagcgacacaagtactcacggtggattttcagttcctcgtcgagctgctgagaagatcttcccatcactagattttactatgcagccaccttgccaggagctaac

SEQ ID NO: 234 - DNA, 420 bp, Eucalyptus grandis
taaaaaccatgcagtctctcagccactgaacatggcgcttgaagctctcaactcgcccaccgccgccgcccccttcggccacgacgacgcggacggccacccgtgggccaaacggaagcgctccaagcgcccccgcgcggaccctcaggaccagccctccgaggaggagtacctggccctctgcctcatcatgctcgcccgccgccgccgccgacccggcagcagcggcaggctccacgagtgctccatctgccacaaggccttccccaccggccaggccttgggcggccacaagcggtgccactacgacggcggcagcagtagcagcgccgcccgtgctgcctcttcctcagaagccggcggtcctagccacacgactgtcagccaccgcgagccgatcgacttgaacttgccggcctt

SEQ ID NO: 235 - DNA, 476 bp, Eucalyptus grandis
gcgacacctactccaaagtggttggtcgctgtttgtcagctctaaaaagcttgttgctggtgatgcttttatatatctcagaggagaaaatggtgaacttcgtgttggagttagacgagcgatgaggcaacttaataatgttccatcttcgattatgccaagtcacagtatgcatattggtgtccttgcaacagcatggcatgccatttcaactggtacaatgttcactgtgtattacaaaccaaggactagccctgctgaattcatcattcctttcgataagcacattgaatctgccaaatttgattactccattgggatgaggttcagaatgacatttgaatggtgaagaagctccagaacagaggttctctggcactgtaattggatctgaggatgttgatcctccgaggtggcctggatcaaaatggagatgcctcaaggtgcggtgggatgaaatcacttccattcatcgc

SEQ ID NO: 236 - DNA, 799 bp, Eucalyptus grandis
cttcctctgtgcatgacatttcagaaaatggggaagctgatgaacagcaaaaacattcagaacagcatgagtcctcccctgcaactggagtgcctcatcctggtgtctctttgcccaatgtccaatatgcaacgcctccacaacttggagcgggacatgccatgacaccacctgcttacccctatccagacccttattatcgaagcatctttgctccctatgatgcgcagtcgtacccgcagcagccctatggtgcacagcctatggtccatctgcaattaatgggaattcaacaagctggagtgcctttgccatcagatgcagttgaggaacctgtatttgtcaatgcaaaacaatatcatggcatcttgcggcgtcgacagtctcgtgcaaaagctgagttagagaacaaagctcttaaatctcgcaagccttacttgcatgaatctcgacatttgcatgcattgagaagagctagaggatgtggggggcggttcctgaacgcaaagaaggatgaaaatcagcagagcgaggtttcttcagcggacaaatcacagggaaatatcaatctcaactctgataaaagcgatcgctcgtcctgaggtgcaacttcctgatcaatgcaaagtaatctctttcgtgcatgaatcatgcctgttcatcaatagatttcccctacctagcctagcctcaccaattgccctgctcttctgcttgtaggtcagtctctttagttggtagtgtgaatctgtttgtagttctgagggaaacctgctgcatagatagtagtttcgagtag

SEQ ID NO: 237 - DNA, 298 bp, Eucalyptus grandis
aagtgaaggatatgtttcaagatcaaagggaaaagtacgacacgttcctcgaggttatgaaagatttcaaggctcaaaggactgacactacaggagtcatagcaagagtaaaggaattatttaaagggcataacaaattaattctgggattcaatactttcttgccaaagggatttgaaatatcccccgacgaggatgaaacaccaataaaaaagaatgtggaatttgaagaagccatctcttttgttaataagatcaagaaacgcttccaaaatgatgagcatgtctataagtcatt

SEQ ID NO: 238 - DNA, 521 bp, Eucalyptus grandis
tccttccttctccttctccttctccttcgtctccttcagacatgtcgctcaaccaccccctctctacttcagacggcacccccaacactctctggtggaccactcaccccaccatgttccgccagcacaacctcctcctcaatttcaaccccaccgacgacgacccgcaagacgagggctcgcccccgccgccctacgtcctccgaggggcgccgccaccggcggagccgtcgcctgcagagaaagagcccatgttcgagaagccgctgacgccgagcgacgtggggaagctgaacaggctggtgataccgaagcagcacgcggagaagcacttcccgctggtgggcgaggcgacccagcagctgagcttcgaggacgagtccgggaagtggtggaggttccgctactcctactggagcagcagccagagctacgtcctcaccaagggctggagccgcttcgtcaaggacaagcgcctcgacgccggggacgtggtcctcttcaccgcgaccgcgccgacg

SEQ ID NO: 239 - DNA, 337 bp, Eucalyptus grandis
gcaattcttgctgccggggaggggcaaatcgggaacagacgataaggggatggcacagcgctcggctccggcgcccttcctgacgaagacgtaccagttggtggacgatccggccaccgacgacgtcatctcgtggggggagagcggccggacgttcgtggtgtggaagacggcggagttcgccaaggacctgctccccagctctttcaagcacaacaacttctccagcttcgtccgccagctcaacacctacggcttcagaaagatcgtgccggacaaatgggagttcgccaacgaccgcttccagcggggccagaaagaactcctctccgagatc

SEQ ID NO: 240 - DNA, 334 bp, Eucalyptus grandis
aggatgtggagggacaagatgcgtctcaagcggctaaaggagcagaacaaggggaaggagggagttgatatcgcgaaacagcggcagtcccaagagcaggcaaggaggaagaagatgtcgagagctcaggatggaattcttaagtacatgttgaagatgatggtggcccactggaaacgaggactggtggccccagctgggtttgccgaaggatcaaggagccccgccctacaagaaacctcatgatcttaagaaggcatggaaggtaggtgttctcacggcggtgatcaagcacatgtcttctgatatcgccaagatacgcaagctcgtgagg

SEQ ID NO: 241 - DNA, 422 bp, Eucalyptus grandis
ttttctcccacctccttctctctcctctctctctctctctacagtttcgcggcgaaatcaagtcccccggcgagctaggtttcaaccggcgaagcagccagaagaagaagaagaagccgaagaagaagaagggcggagatggatcagtggaggacggatttgggagcgtcgacttccgtccacccccagcagcaccagcaccagcaccagcaccacccgtccagcaggctgcacgcctcgcacgacgagcccaggcaaagggaggaagcggacgtcagggatcccgtggccgcgaggaaagtccagaaggccgaccgcgaaaagctaaggagggatcgtctgaacgagcacttccttgaactggggagcacgctagatcctgatagacctaagaatgacaaggcaaccattctcacggacac

SEQ ID NO: 242 - DNA, 737 bp, Eucalyptus grandis
aaaaagaccatttcttccgaacacaagaggaggcgggtggtggtggtggtgttgctgcttctggtgccgtccacttccttcttcccacctccatcttcatctctccctccctctctctctctgaatctaccgaacccttctcgccgaaggaggagagagagagagagagagagagagagacgggaagaccatcgctttcggccatcgcgtgcacgagcagtcatgaggagaggcagatgcgccgccgcggccgcgaagagggaggcggccgagatagcgccgccgccggtgccccatgcggctgcggcggcggcggcggaacccagatacaggggcgtccggcggaagtcgctgggccgatacacggccgagatcagagaccccgggacgaagaagctcgtgcggctcggcactttcggctcgccggaggaagcggcgcgtgctttcgacgcgaaggccgtggcgttccgcggggtcaaggccaggaccaacttccccgtcgccccgtcgagtttccctccggccgcttctcgcgatctgcgagctccgttgattgaatccagaaagttcggtcggagaggcgctcgagatcttcgcggcgaccaccacgacgtcagcccgcagagaccgacctcgagcagcttaagcagcaccgtggtgtcgtccagtggtcctcgaccgtcgccgtcgccggagacggcgaagcggcggactaggactccgccgcgccaccgccg

SEQ ID NO: 243 - DNA, 542 bp, Eucalyptus grandis
ctacaatagcaactcagatcccattagagaggaattcatgaaagcactagagccttttatgaaaagtgtttcccctgtttcttctccattatcatcattatcatcttgtgactcggtctttccaaaacaacagcctaatttgaatcctgacctttgctcctcttggatagtaaacccgatgggtctcgagcaatccggctcgattgggctcaaccgactctcccattctcaaatccaacatatccaggacgaaatgctactccgacgtcaaaatcaagaactttggttagcttccgctgtgaaatctcctctccagcacgaaaaattcgaccagtgtcggtaccaaaaccaccacggctctccccatctcctccggccgaaagccctctcaatgaagcgggtgggagtccctccgaaacccaacaagctttacaggggagtgaggcagaggcactgggggaaatgggtggctgagatcagacttcccaagaacaggacacgcctctggctcggcactttcgacaccgccgaggaggctgctc

SEQ ID NO: 244 - DNA, 848 bp, Eucalyptus grandis
gagagagagagagagaggaaggggtgtcatggatttgttcttccacgaagaggttcaaagcgacatcttctggtgcgatcaactggtggagccgccgccgccgccgccgccgccgctgccgccggctaacccaagcgccttttcaccgtatacaaaccggctgccgagtcaagaccgagggttcatgccgaacccggggaataatatgaacaagcgggtgatggagttcttgaggaggagctgggccgaaccgagccagatccaagaattcgaccgcgaacggggttttcgacacatgctgagcgagaggatgaggagggagaagcagaagcgtagctactcggcattgctctccgaattgcctcatggtaccaagaatgacaagaactccatcgtccaaacagcttgcatgagaatcaaggagctggtgaagtacaagcaagagctggagagacaaaacggggagctgaagtctggactgaacgagaagagcggaggggacaaagctgaagggaccaagatcagagtcaagattgcgaacccgacgtccgggattgattctatgttggaggtcctcaagtgcctggacaacatgggactgaaagctacggcgattcaaacgcagtgctcggccgaccaactcttcgccgtgatcgaggttgaaaatgaggtatgtgcacaacaatccgatgccaatgtacactaatcactggttcatgttcttcgcacgtgattttcatttttctcgaatgtaaagtaagaacttgtacgatgttcatgcagcacaagttcgaaattttcccagtccatgggaaggtccggcgtcttcgtttctggtgccaagcatg

SEQ ID NO: 245 - DNA, 181 bp, Eucalyptus grandis
gacatggcgcgacgtggcggaggaaggaggcgaacggcggctccgaggcgtccgacgccgtcttgccgcgagctcatcatcgccatcgttacaagggagtgaggatgcggaagtgggggaagtgggtggcggagatacggcagcccaacagccgggaccgcatctggctcggctcctacgc

SEQ ID NO: 246 - DNA, 117 bp, Eucalyptus grandis
cgagctgctgcagatccagaggaagaggaagaggatggagtcgaaccgggagtcggcgaagcggtcgcggctgcggaagcagcagcacttggacgagctcacgaccgaggtgggtcg

SEQ ID NO: 247 - DNA, 597 bp, Eucalyptus grandis
tctctctctcttcgtttctcccgtttctctctctctacctctcgccaagaaaccgccaggaaaggaaggaaggtaaaaagaaaagaaaaggaagccatggctccgagagaaaagcccagcgtcgccgccatcccaaaccctaacggcgctaaggaaatccgtttccggggcgtccggaagaggccctggggccgctacgccgccgagatccgggaccccggcaagaagacccgggtgtggctcggcaccttcgacacagccgaggaggccgcccgcgcctacgacaccgccgcccgcgagttccgcggcgccaaggccaagaccaacttccccacctccgccgagctgatctcctcctcccgcagccccagccagagcagctccctcgacgagccctcccccccgccgccggccggggccgtccaggccgccgccctcggcccgcccctcgacctcagcctcggccgccaccccgtcgccgccgccgccgccgggcccgggccttacttccccggcgcggccgcaatgtgcttcccggtgatgcccccgccgccgcggccggtgttcttcttcgaccccttcggccgcatggagcat

SEQ ID NO: 248 - DNA, 361 bp, Eucalyptus grandis
gaggctcagtacttcgtgtagccatggggcatgaaagtgaagcatttgaagagtttgttgatgcgcacaaaacttgcttgaatgatctcatgttcttccctactcgtaatgccttggactctcaagtgttgctgcaaatgcagaaaagcttgctgccttgcagaacgaatatcattttgctaaagcaaggattgatgaagatcatgagaaggcgcagcgactggagaagaaggtcaaaactctcacattcggctatcagatgcgggagaagactcttcgagaccaaattgagtcaaccttcaagcagctggacactgcagggacagaactcgagtgtttcccagctctgcagaagcaagag

SEQ ID NO: 249 - DNA, 472 bp, Eucalyptus grandis
ccatcgtcacctgtatccacaaaaacacacccaccttacctctgcacccgccccacccgcctatcgcagggcctgcgatacagacgcttggctgccaagcatgaagagaagccctccgctgtgctcgacaaatcccaagatcccacagacagcgcaaagccatccaagaagccccgccatcgtcacagtcccacccagctcgctgccctcaacgaactctttgagaaaagcgaacaccccactcttgaggagcgaggccagttggctgagaaattaggaatggagaccaagaccgtcaatgcatggtttcagaacaagcgtgcttctactaagaagcgcaataaggggggaacctcggaacctcacccagccacgagtcagaacgacttgtccgaagatgctctcaaaaccccttccgcactgccgtcgatagcgaacctgctcaacgacgcaccctcatcggcctcgccgc

SEQ ID NO: 250 - DNA, 302 bp, Eucalyptus grandis
ccccgcccacttatctgctatcctcgctacttcgctctattagtacctccacaatcccatgcgcaaacgccaacgcaccctcgacatgcacgccggcgcaccaggtcccaacgatgccattgacgcgaacagcgtcggcgacaacgcgttcatcgcggatcacgacgcaattgactcggccggcgacgacgacgacgacgaagacaagcccaagaccggccagaagcaaggccgccgcaaaataaagatcgagtttatacaggacaaatcgagacgccatatcaccttctccaaaaggaaag

SEQ ID NO: 251 - DNA, 708 bp, Eucalyptus grandis
gatcacgttccttcttcgagtgctctggacagtaggagctcctcaaaccgtacttctggggtgaccttagcagaggttttaccaacacccgggcagtctaagagttcagctgattcaggcttttgtgtcagtcatcttggtggggttcctgattcacaatcttcttcatacgcagcagagcatgttaatacacatcagactcaagagatacatttgccagtgccgcaggacaatgcagatctccctgatgcaaactttttggtttcggaaactgcaagtcctgactatcttgaaactctgtccgcagctttagatgggaccatggatgtcgagtcagatgctttttcttctgaacgagatgcgggaattatgctggatgatgtaactaatcttccagcgatcagtgatgtcttctgggaacagtttcttgcggcaagtccacttactgcagacacagaggagattagttcgacctctcatgaaactggcatcacgaatgatcaagagtcacacactaaggtggagaatggatttgagaaggcccattacatggatcatcttaccaaacagatgggtcatctcacctccaacaacggaacaggatgatatgttcttatctactttgtacactggataatctctttcagactagaggtgaatgccaatgcaggatgcgaataacaaattatgccaaaaaaaaaaaaaaaa

SEQ ID NO: 252 - DNA, 563 bp, Eucalyptus grandis
atttttcaactccccccccccaccccgaatcaaatcccattccctctctccctccctccctttttttcccccaatcttttgttgcgttttcaagcacccacgccccccaatctccaacgccatcaatcaagctcaagcaccatcacctcaagaagaaagaaggaaagaaagagagaaggaccggagacccgacagagggtcgcgcgcgcacgagacatgggacgatccccttgctgcgagaaggcgcacaccaacaagggcgcgtggaccaaggaagaggaccagcgcctcatcgactacatccgcctccacggcgaaggttgctggcgctccctccccaaatctgccgggcttctcaggtgcggcaagagctgcaggctcaggtggataaactacctccgccccgacctcagcgcggcaacttcaccgaggaagaagacgagctcatcatcaagctccacagcttgctcggcaacaagtggtctctgatcgcggggagattgcccggaagaaccgacaacgagatcaagaactactggaacacccacatcaagcgcaaagct

SEQ ID NO: 253 - DNA, 397 bp, Eucalyptus grandis
cctcgatgtaacgaaacgagctgcacgaggaatttgccggtagagagataaagaggagcgatggagatgaagggaggggtcgtcccgaaagaggaggaggcgtcgtcggacgtggggcagccgccgccgccgccgccgccgccgccgcagcccatggaggggctgggcgaagcggaggccgcgccgttcctgacgaagacgttcgagatcgtggaggacccggcgacggacccgatcgtgtcgtggagcgaggggaggaacagcttcatcgtctgggacgcccaccagttcgccgtcaccctgctccccaagcacttcaagcacggcaacttctccagcttcatccggcagctcaacacctacggtgtgttcgatgagtatgatactgcaagtttta

SEQ ID NO: 254 - DNA, 353 bp, Eucalyptus grandis
gaattacacccaaccaaaccaaaagagtcataattcaggatccaccttgtttagttaagcaagaataattttcccttcccttttctctttttgagccctttagagttacatgtcttgggtagcaatgacggggaactttgggtggggctcaaactccatggaagaggcgtggaggaaaggtccctggactgctgaggaagacaagttactcattgagtatgtgaagttgcatggggaaggaagatggaactctgtagctaggctcacagggctcaagaggaatgggaagagctgtagattgaggtgggtgaattacttgaggcctgacctgaagagaggtcagataacccctc

SEQ ID NO: 255 - DNA, 541 bp, Eucalyptus grandis
accaccaccagtaccaccacctccctctctctctctctctctctctctccttttccctctgttcgtgttcggtacgattgcgaagcggaaagcgaatgctcctctccggattgccatgaactccaacgcttcctccaacccccagtcgatggccacctccacgacgtcggcgaccacgccggcggcgggcggcgacggcggcaagaaggtcaggaagccctacacgatcaccaagtccagggagagctggaccgaggaggagcacgacaagttcctcgaggccctccagctgtttgaccgcgattggaagaaaattgaggattttgtgggctcaaagactgtcattcagatccgaagccatgcccagaaatacttcttgaaagtccaaaagaatggggcagttgcacatgttccacctcctcgtcctaaacgcaaagctgctcatccctaccctcaaaaggcatcgaaaaatgttttagtgccgctgcaagcatccatggcccagccttcttcaacaaatcctgcttttacaattacacct

SEQ ID NO: 256 - DNA, 477 bp, Eucalyptus grandis
agatagtccaagctctctgcctctctctctctctctcttctctatcttcatcttcgtcgtcttgatcgctctcatctcgctctcgcgaatgttgtctctcgtcttctcctctgtccgccattcaaagatcacctattctttccgtttggtttgcggtgactaagaactctttctctctctcgctctgtgtcactcttgctttctcccgacttttctgggattgatgaaaatggcggaaagatcgaactcgtcggacccggaaacaagcccctcgaactcaccctccacctcctcgtcttcttcctcgtactcgcccgacccgcgccgccgggccggctcgcccgccgcggcccgcgacccgttgagatcctccaagcggagcaagcacccggtgtaccgcggggtccggatgaggaactggggcaagtgggtgtcggagatccgggagccccgcaagaagtcccgcatctggctcgg

SEQ ID NO: 257 - DNA, 351 bp, Eucalyptus grandis
ggaaatggaggtcaaggtttaggatggccgggtttcaacagttcccattgagttctgcagttactgatgctgtcagaaatctattaagggaatataacgagaattatagaatcgaagagaaggatggagctctttatctctggtggaggaatcgagctatggcaacttcttctgcgtggtggtgaaacttgtgggttttgacgagtctgtaaagttttgtactagttgtagttcatgtttagcttgatgattagctttaattctacttccataggatcaagggagcaatgtctagaacttccactacactgtcataaaattcccaacttgaatttgaaaaaaaaaaaaaaa

SEQ ID NO: 258 - DNA, 360 bp, Eucalyptus grandis
tggtgtagggttccctgatcctgggcccgacaatggccaggtgctggatgctcgggacccactggccgagaagaaacttgaacttgcaacctgccaaaggagggtagaagaagaaatgctgaaacattccaaggcagtggaagtgacgaggacaagtaccttgaacaatcttcaaacgggtctgccaggagttttccaggcattagccagtttttcatccttgttcatggaggtccttgacacggtatgtacccgttcttatgctatcaaatagacatatgtatacacattctttcggtccggtatttttgttgaagtgggaaagatgagagctgggtaattttggcggttagctctcgc

SEQ ID NO: 259 - DNA, 318 bp, Eucalyptus grandis
tccttcctccctccctctcgccccttctgaatagcccgagatatttaattctctctcctccgtttctctcctcctcccgctcctcctcctccatcatttcctcctgaaccttctggaatccgtcatcgtctcgccagctccgatcttgtccccctcgctgccatggccgccccgccggcggagcagagcggctcggcctccggcggagagagccagcgctccgtccccaccccgttcctcaccaagacgtaccagctcgtcgacgaccccgccatcgacgccgtcatctcctggaacggcgacggctcctccttcatc

SEQ ID NO: 260 - DNA, 503 bp, Eucalyptus grandis
cctaaatcagctgcgaagtcgtcttatcctcttcgattcctgaagaatcgtgtcgctcttctcctcctcctcgacgattaagaatccgattttgatcgcggcggtcgatcgtcggcggctccgattcggcggcggcggaggcggaagatcggttgctcggcgcagcttcgcgtttttccggctcgaatcgcgctgccgggtgaggtaggtgagtgtcgggatcgtgtttttccggaggtcttcgcggcgtcgcttctgtttgatcggattgtggtctgattagccccccctaacttacgccggcgtgtttgggttagggttcggttcggttgggggtgtttcgaagatggacccgatggatatagtggggaaatcgaaggaggatgcgtcgctccccaaagcaactatgacaaaaattataaaggaaatgctaccgcccgatgttcgtgttgcacgagatgctcaagatctattaatcgagtgttgtgtagagttcataaacc

SEQ ID NO: 261 - DNA, 546 bp, Eucalyptus grandis
agaagcgctgagttcttggtcaaagtctagcagtttcgggttctccatcaatcgagtcggagtgggagaaaatgagcacaaatggtttgctgaagtttgaccaaagtctttagtgagatggttgctgtctccccgttctcctccaaacagatgtctgatcaaataacttacttgaccgccagtatgaactctcctttagcccagcttgttaacccaagaaggatgcacacctacgagccatttgaccagttccccatgtggggagacaccttcaaagctgacaaggtcaaaaatctcgaggcatcgtcatctgtgatcgtgcatgcagtagatgatggattggacaagaagtttgaatatgtttctcatgaatcggcagaaaattccagctccaggagcgatcaagaagcaaatagacctgacaaggtacagagacgtctagcacagaaccgtgaagctgctcgaaaaagccgtctgcggaagaagaaatatgtacaacaactagaatcaagccgcttgaagctagcacagttggagctggaactc

SEQ ID NO: 262 - DNA, 883 bp, Eucalyptus grandis
gcttcgtgtacgggatcattcccgagaagggcaagccagtgagcggtgcctccgacaatctccgagcctggtggaaggaaaaagtgaggttcgaccggaacgggcccgcggcgatcgccaagtaccgggcggaccactcgatccccgggaacggcgaggacgcggccaccatcggccccattcctcacaccttgcaagaactgcaggacaccactctcgggtcgctcttatcggctctgatgcagcactgcaatccaccgcagcggcgattcccgctggagaagggcgtggctcctccgtggtggcctacaggagaagaggagtggtggccccagcttggcctgcccgccgaccagggacctccgccctacaagaaacctcacgatctcaagaaggcttggaaggtgagcgtcctcacggctgtcatcaagcacatgtcgccggacatctccaagatcaggaagctcgtccgtcagagtaaatgtctgcaggataagatgaccgcaaaggagagtgccacgtggctcgcgataatcaaccaggaagaagctctgtccaggaaattgtaccccaatagcttcccgcccgtgtgttcggacagtggatttgggtcctatgtcatcagcgatgctagtgattatgatgtggaaggagctgatgatgaaccaaagttcgaggcggaggaatgcaagccttttgatccaagtgcttttggcatcgggccaagggtgtctacaggcgagcttttgatccatccactggtttctcaaatcaaaggagaagttaatgaaaccaaaaccaattcgcggctagtttcaaagaggaatcaaccatccgatgagccgaaggcgaagatggatcagaagatatacacatgcgagtt

SEQ ID NO: 263 - DNA, 454 bp, Eucalyptus grandis
gttcgacgagttcacagcgagctgacaaatcattgatcatggagcatgagtttagttcggctaaaatcaaagctcttcttgagattctacagtcgcaatgcagaggagaaagtgcaaatgcagagcttcatggtcccatgggctgtgacgatgagtctctttttgaaaatacaggcaccggggattctacatacagagttaaagctgttaagcacacaactgtttattcaagttctcctcctgaaggaccaattaaagcaattgtcttttctcagtggacgagtatgttaaacttggttgaacaaaatctgatccattttggcataaattatagacggcttgatggaacaatgaccctttctgcaagagacaaagctgtgaaagattttaacaccgatcctgagatagtcgttatgctaatgtcattaaaagcaggaaaccttggtctaaacat

SEQ ID NO: 264 - DNA, 579 bp, Eucalyptus grandis
agtgaattcggtggggagttaatgaatccaagaagcaactggctaattgtatataatgatgatgagggtgacatgatgcttgttggggatgacccgtggcaggaattttgtggcattgtccgaaagatttttatttatactagagaggaggttcaaaagatgaagccagggactattagtgccaaagatgaggacaatttgatggtcgatgaaggggtgttttcaaagaaaatgacttcggacacgctgccttcggcgtctgacccaaagaactgttaaaattctctcatgtctgtgaggtctttaaagtcattggagaagcctaatccagccgctacagttccctgatgctgaaattcatctttgtccacggggactgcacataatcttctctgtctatatcctctgtgcttcagtgaccattttctgccccgcaaagccgtatttgtatcatcaatgggattcttggatttggcttcaagatgcatggccccctgaggaggccagagagcctgacagagaactacggcagattgaaaaggagagaaatgaggcctgttcgtattcagcattttgaga

SEQ ID NO: 265 - DNA, 366 bp, Eucalyptus grandis
atcgaggccctgaaaaaacggttggacgatgtgaatgccaagtatgcggtctcggtcgagttcaccaaggccatggcactgaaccacctcaagaacggcctgcctcgcgtttttaaggcattgatggaattctcaggtgcttgcactaaggtattcgaggctttgaataacccccgcgagcaggtaggcagtcgtgagaatgagccgcgggttttgcctgcgtgatttcatggatgcctcaggccgtgtgtataatttgtttcaacatttggtaaaccttgataaggtgtcattgcatttgcatagaaatactgtgaaattcttttttaattttggtttgatcttagcttgaaaaaaaaaaaaaaa

SEQ ID NO: 266 - DNA, 376 bp, Eucalyptus grandis
gcagattctccccccgaacgccaagatctcgaaggaggcgaaggagacgatgcaggagtgcgtttctgagttcatcagcttcgtcaccggtgaggcctcggacaagtgccacaaggagaagcgcaagaccgtgaacggcgatgacatcgtctgggcacttgggtccctagggtttgatgactatgccgagccgctcaagcggtacttaaatcggtatcgggaggtcgaaggggagagggccagccaaaacaaggtcacaggcggcgaatcaagaaacgagaagaacttgtacggggatgagtcgccggagaagcagctgggcgctgcctcttcgtcgcctctgaagttctttgatgtggccgacaggagtaccaat

SEQ ID NO: 267 - DNA, 341 bp, Eucalyptus grandis
gtcaactcggtgttcgagctgcacaagctgctggcccgcccgggggcgatcgagaaggttctgggcgtggtgcggcaggtgcggccggcgatcgtgacggtggtcgagcaggaggccaaccacaacgggccggtcttcgtggaccgcttcaacgagtcgctgcactactactccaccttgttcgactccctggagggctgcgccagcacgcaggacaaggccatgtcggaggtctacctcgggaagcagatctgcaacgtggtggcgtgcgagggcgccgaccgggtcgagcgccacgagaccctcgcccagtggcgggtccgcctcggcggcgccgggtt

SEQ ID NO: 268 - DNA, 343 bp, Eucalyptus grandis
tcgctgttcaatacctccaagtcgaacaagcacctctgggagcagatctcgtccaagatgagagagaaagggttcgatcgttccccgaccatgtgcacggacaagtggaggaacctgctgaaggagtataagaaggccaagtaccaggatagaggatccgcgaagatgtcgtattacaaggagattgaggagattctgagggagaggagcaagaataatcagtataagagtccgacggcctcggctttgaaggtcgatccctacatgcagttttctgacaaaggcattgaggatgctgggatgactttcggacctgtagaagcaagtggtaggccgactctca

SEQ ID NO: 269 - DNA, 546 bp, Eucalyptus grandis
atgacctcgaactaaaagtgcgagaactggaaactgtcatgctaggacccagctcagatatgccccacacggttgatatcaacttcttggttggatctggccagatgtctcaggagacggagacattgatggagattatctccaggagggacctaaaggagattctctgtgcttgtgctaaagcagttgaagacaacgacaccttaaaatttgagtgtttaatatcagagttacgcccgatggtgtctgtttccggtgacccgatccaacgattatcagcatacatgttggaagggctcatagcaagattggcaagttcgggaagctctatttacaaagctttaaagtgcaaagagcctgctggtgcagagctgctatcgtacatgcacattctctatgatatatgtccttatttcaagtttgggtacatgtcggcgaacggatcaatcgcagaagtcatgaaggacgaaaacattatccatataatcgattttcagattgctcagggaggccagtggatcaccctgattcaggctcttgcagcac

SEQ ID NO: 270 - DNA, 283 bp, Eucalyptus grandis
ccccattttcccgtttctcccatattcctcaagcactctcatttagggaatgagtgcttagaagccacctcaagtttcaaatttttttcctgcgcagttctcaattcaaatggcacgtagctcatgtaatcagaaactgaggaaaggtttatggtcgcctgaagaagacgagaaactgttcaattatataagtagacatgggttgggatgctggagttcggttccgaagctagctggtttgcagagatgtggaaagagttgcagattgaggtggatcaactat

SEQ ID NO: 271 - DNA, 377 bp, Eucalyptus grandis
atttcttcctggttcttgatagaagattgaaggttctagaacaagaggaagaaagctagtgcaaaagaaagaaagtaaaaagaggtatttctgctgctttattagtttattgtggagtatggcaagtggaatggagaaccggggggaaattcctgcgaatttgaagaaacagcttgctctggctgtgagaaaaatccaatggagctacggaatcttctggtccatctcaaccagacagcctggggtcttggagtggggtgatgggtactacaatggagacatcaaaaccaggaaaacaattcaagctgtggaacttaatactgaccagattggtatgcagagaagcgagcaactgagggaactatatgagtctctat

SEQ ID NO: 272 - DNA, 548 bp, Eucalyptus grandis
ggaatatccagaggaatgagtaccataatctttttaacttcatcagtgggaaggggttgaagatcatgaacttgggagagcagggcgctgatggagtaccaggcgttcttgatgtggatgacgacgatgctgtcgatccccatcttgagcgcatcaggattgaagccggtgtagatgaaagtgatgaagaggatgaagattttgtcattgataaggatgatggaggatctcctactgatgattctggagatgacgagtccgatgtcagtgaaagtggagatgagaaggagaaagagaagtatgggaaaaaggaatctcgaaaagaagtcaaagcatcatcaagcaagaagaaagcaaaagctggagatgaagaggggtcgaagaagaagaaacagaagaagaaagaccccaatgcaccaaaaaaggctatgtctggttataactttttcttgcagacggaaagcgagaaaatgaagagaactaatcccggtctttcctttggggatgtatcaagagaaattgcagacaagtggaggggtttgtcagcg

SEQ ID NO: 273 - DNA, 420 bp, Eucalyptus grandis
tctctctctctctctctgtgaagatcctctctagcgataaatcactgttgcccatttcttccttggctccgttctgttgcttcctctctctgtcttcgacacttcaactgtgcgagcccaaaaatcgatccttttctgcttccttttgcctctgttccaagagtcaattgatactgggtcgatctggtcggcaacttttgttggaagtttgaggaatctgattgagagaagaggtagatctaaaggatcaaaaggatgtcatttaccggcacccaagttaaatgcaaggcttgcgaaaagacagtttatcctgttgaacagttatctgcggatggggttgcataccacaagtattgcttcaagtgcagccactgcaaaggcacattaaagctgagcagctactcctcaatggaaggagtt

SEQ ID NO: 274 - DNA, 454 bp, Eucalyptus grandis
gataaatcgtcttcaccagtacctccgcaggatcagacgggtgttcatgtttatcatcctgattgggctgctatgcatgcatactatggtccaagagttgctcttccgccttattataattctgctgtatcatctggtcatggtcctcatccctacatgtgggggccaccacagcctatgatgccaccatatgggccaccttatgctgcaatatactcacatggaggtgtttatggacatcctgcaattcctcttactccgactcccttggctgcggaaactcctaaaaagtcatctgctaattctgataatggactggtgaagaagttgaaaagttttgaagggcttgcaatgtcaataggcagtgggggggatgcagacagtgctgacgatgggactgataaaaggtcatcacagagtgcagactcgggagactcaagtgatgaggatcaat

SEQ ID NO: 275 - DNA, 620 bp, Eucalyptus grandis
gcgatttaaacagctactggaggaggcatcacaggatattgatcacacaactgactattacacttttagaaagaaatggggcaatgatccacggtttgaggccttggatcggaaagatcgagagaatttattgaatgaaagggtcctccctttaaaaaaggctgctgaagaaagggctcaagcaatgcgtgctgctgccacttctagttttaaatccttgcttcgagatagaggagatataactgtcaattcccgttggtccagggtaaaggatagtctcagggatgacccaagatacaagtcagtgaagcatgaagacagggaggccttgttcaatgagtatatagctgaattgaaggctgtggaagacagagaagaaaaggaggcaaaagctaagagggaagagcaggagaagctgaaggaaagggaaagagaattgcgaaaacggaaggaaagagaagaacaagaaatggagagggtacgagtgaaaatacgcaggaaagaggcaattgcatcttttcaagcattgcttgttgaaacaatcaaggaccctcagcttcctggacagagtcaaaagttaaacttgacaaagatcctcaggacgtgcgagtaatcctgat

SEQ ID NO: 276 - DNA, 340 bp, Eucalyptus grandis
gagataaagaactactggaatacaagaattaagcgactgcaacgcactggcatgcctatatatccaactgaggtttgtctgcaagtgtcaagtgagaatcaagaaactcataacatgggtaacttgcatactgcaggcgaagataattgtgatctctcacaggcagatccactcgagatcccagaggtggattttagaaaactggaactgcatcttggtttctcgtctttttggtctacacttctggacgttcctccttgtggctttgggagagaggcaatgtgtctatctgatgcttactgccttccatttccatcaagccggtctcctaaacgccttc

SEQ ID NO: 277 - DNA, 351 bp, Eucalyptus grandis
cgacgacccgcatacccgctgccaatctggaggacctatttgacaaccataacatggctcgaatacgggacgtatgggccccgaatcttgagatagagatgcagaacatccgcgaggccatcgagaaatactcgtatgtttcaatggacaccgagttcctgagtggggcgcggcccataggtaacttcaaaacgtcctcggactaccactaccagacgatgcgctgtaacgtcgaccttctcaagatcatccaagtcgggatcacgctggcagacgaggaggggttgttcccgcaggactgctctacgtggcaagttcaactttaaatttagtctttggcgacgacatgtc

SEQ ID NO: 278 - DNA, 337 bp, Eucalyptus grandis
gcagccgagtcgagcaagaaactaacgaacgcccggtgtcattaggattcataatccacaagaacaaaagaaaaaaggatcatgggaagatccccatgttgcgaaggcaatggcctgaagaaagggccctggtcttctgaggaagacaagaagctccttgattttatccagcagcacggccatgggagctggatctctctccctaaacgtgcaggtcttaatagatgtggcaagagctgcagattgagatggataaactacttgtggccggacatcaagagagggagtttctccccggaagaagaacaaaccatcttgcatctccactccgtgctcg

SEQ ID NO: 279 - DNA, 383 bp, Eucalyptus grandis
ctccaacgcgcgccttcttctcctggactcctctgagctctctccatctcctccggctcggcgcggccgtcgctcgacggcgacgactcgagggtttccatataattcacttgaaagaagctgcagaatgccgtggaaaacaggacttaccggctctaaaacggaagaagataaggctctgcagctttgtcgggagagaaaaaaatctgttaggcaagctgttgatggttggggctcccttgtgtatgcacatttcatgtttgtgcaatcattaaggaacgtagggacagctctcacaaagttctttgaaacagaatctccaaatgggtctccctcgtatgcctcaatgagtacaacacctgagccaatcgcattaaccgaga

SEQ ID NO: 280 - DNA, 312 bp, Eucalyptus grandis
ggtttgctcagatgcagcaagagctgcaggctcagatggactaattacctccgtcccggtatcaagcgcggtagcttcacggaccaagaggaaaagatgatcgtccaccttcaggctcttcttggtaataggggggcggccatagcttcgtaccttcctcagaggactgacaatgatatcaagaactactggaatacccatttgaagaagaagctgaagaagcttcaaggccaagcaaatcctgatgatgatgaccataatcatcacccacaagggttcaacgcaacttcacactccaaccccaagggccag

SEQ ID NO: 281 - DNA, 311 bp, Eucalyptus grandis
gagatggcgaggacaccatgctgtgagaagatggggatgaagaaagggccgtggactccagaggaagaccagatcctgatctcccacatccaccagtttggtcactcaaactggcgtgcacttcctagacaagcaggtctgttaagatgtgggaagagttgcagactccggtggataaactacttgcgacccgacgtgaagcgagggaacttcaccgacgacgaaagagacaccatcattgaacttcatcaagttcttggcaacagatggtcggccatagcctcgagattgccggggcgaacggacaatga

SEQ ID NO: 282 - DNA, 378 bp, Eucalyptus grandis
catggacagctgaagaggacaagaagctcatcaacttcatcctcacccatggccaatgctgttggcgggctgttcccaagcttgctggactgctgcggtgtggaaagagttgcaggctgaggtggaccaattacctgaggccagacttgaagagaggccttttgtccgagtatgaagagaaaatggtcattgacctccatgcgcaacttggcaacagatggtcgaaaatagcctctcacctcccgggaagaacagacaatgagatcaagaatcactggaacactcacatcaagaagaagctcaagaagatgggcattgatcctctcactcacaagccattagtcaccaacaacgacaacacaaccgatcaacaacccc

SEQ ID NO: 283 - DNA, 389 bp, Eucalyptus grandis
ctccctcctcctccaaacgtttccgtttctctccaagctgaacatggacaagaagccagacgacgacagtggtaagtcccaagatgtcgaggtgagaaaagggccgtggacgatggaagaggatctcatcctcatcaactacatagcgaatcacggcgaaggcagttggaactccctagccaaagctgctggtctaaaacgtaccgggaagagttgtcggctccggtggctgaactatctgcgacccgacgtccggagaggcaacatcactactgaggagcagctcctgatcatggaactgcatgccaagtggggaaacaggtgagatgcacataagtcacacaacttttcgttacataggttctacaacataatacccatcgatcata

SEQ ID NO: 284 - DNA, 385 bp, Eucalyptus grandis
ccaatggtgacagtgttaaggatgaccttgatacagatgaatatgaaactcatgccacagttttggataagctattagcatgggagaaaaagctctacgaagaagtgaagcaaggtgagcacatgaagctagagtatcagaaaaaggtggctttgctaaacaagcagaagaaacgtggtgctagtggtgaatccctggagaaaacaaaagcagctgtaagtcatttgcatacgacatacatagttgacatgcagtccatggattcaactgcttcagaaataaaccacataagggacaaacagctgtacccaaagcttgcgcaacttgtcgatgggatggcgaatatgtgggaaaaaatgcgcatgcatcatgataagcaggagtc

SEQ ID NO: 285 - DNA, 461 bp, Eucalyptus grandis
caccggaaacagtccatgttcagaattattctccaattcatcaaatgggcattgatggattctttccagcgcatccctccccacagaatccttcgtaccattcttactcccccaacaatagacccaatttccctcctccgtcccctcaaacttcacagtgggactatttttggaaccccttttcatccctggactactatggataccccactcggagtagtattgatcatatggctatggatgatgagaccagaggattgaggcaggtccgagaggaagaggggattccagacttggaagaagaaactgagcacgaagaatgtgatcaccactcgtatgttgatgaagatagaggcaacagagatgctaatttccccactgaggaagttttagtggaagatgttgatgacgaggaagaggatgaggatgaaggaaacagacacagctgtgaatctgaggat

SEQ ID NO: 286 - DNA, 438 bp, Eucalyptus grandis
gtactgcgggctcagctgatggaattgaccgacaggctgcggtccttgaattcagtgcttcaggtcgtggaggtggttagcgggctcgccatcgatatacccgagatacctgatccgcttatgaacccatggcagctgccctgcccgatgcagccaattacggcgtctgccgacatgttgcagctgtgagcatcagattggaagtgtaaaagttggggctgattcttttggagtccccttctggggggatggtagatccatagccatttgctgcttttgtttttcttgtcaattccgttctctttcttgaagttggaactccaatatctgtatgcgtctgtctagatggactggcgcttttatgtctgcttgacattgtacttggctgttcttgcttgttacttatgggatgttcctgttctaaaaaaaaaaaaaaaa

SEQ ID NO: 287 - DNA, 405 bp, Eucalyptus grandis
ctgaccttaacagctgcaagcactgttatatttgcagagctatcgtggacaccgggtgatctgatccaagctgaagatcgtgctcacaggattggtcaggtatcttcagttaatatatattacctgctggcaaatgacactgttgatgacataatatgggatgttgtccagagcaagttggaaaatttgggtcaggtgcttgatggccatgaaaatacattggaagtctcagccagccaaccaactagaaacagccctgcaaagcaaaaaacctttaatagccctggcaaacagcatacatttaatagccctgggaagcagcaaaaatttaatagccctggcaagcagacaacactcgactcgttcatgaagcgttgcaatagtggtgacccctctgaacatcag

SEQ ID NO: 288 - DNA, 515 bp, Eucalyptus grandis
ccctcttcctcttcctctccctctctctgtcgcagagctccgtctgaactcgcagaatccacgcgcagagcgacccaagagtgtttcagaacagtccgtccatggccttggaagctatcaactctcccaccgcggcctcagcgccgttccagttcatggaggagcccttgagctcccgcttcttggagcccctgaacaagcgcaagcgctccaagcgcccccaccaccctccctccgaagatgagtacctcgccctctgcctcatcatgctcgcccgcagcggcgccgcccccaagcccaaccaccacgcctcgcccgctcctcttcctcctcctcctcctcctgcgcccactaagcctgaagaagccgcggcgaccgccacggcaaccgcggccccggcgaataacttgagctacaagtgcgccgtctgcggcaagggcttcccctcctaccaggccctcggcggccacaaggccagccaccgcaagtcggccgccgccgccgccgccgccgcc

SEQ ID NO: 289 - DNA, 375 bp, Eucalyptus grandis
ggcaattgctcttgtcctagccaaacgggaaatcatccgtagcataggcactggattggactggtcctcaccttcggcaggttcatcgacaagtttgcctgaaattaaaggaacccttgtcatatgtcctgtggttgctgtgactcaatgggttggtgagattaattgctccactgcccaaggaagcactaaggtcctagtatatcatggagcaaatagaggaaagactgctgatcagttcaagaactttgattttgttgtaaccacatattcacttgttgaaggcgagtacagaaaatttgtgatgccacccaagaagaagtgcatttattgtgggaagttgctttacaaggagaaaatgacagttcaccttag

SEQ ID NO: 290 - DNA, 590 bp, Eucalyptus grandis
cccagatttaccaggagatgacttagcattggaattcgaggaattcgatttccagagcctgttcgacgaattatcgcctgatgccgcgggccttctcgacgccagcgatgtcgatgcttcgtctccgggatcgctgtcctcgtggatcggcgagatcgagggcatgctgatgaaggacgacgaggaagccgtcgccgtcgagccgagtcaggaggtcttcgatcgcttcttcgccggcttgctcgttgattcccccgagggcggaccggccgaggcgaccgacggcgcgagcgacaaggagtccaattcatccgacggcggcggcggcggcggcggcgaacgggatgagaagctggtcgtcggagataacgagctttccgaggacgctgatgatgatgatcccgtctctaagaaacagagaaggcagctcaggaataaggatgcggcggctaggtcgagggagaggaagagaagttacgtgaaagagctggagatgaagagcaaatatatggaaggggaatgccgcaggctggggcggttgctccagtgctttgtggctgagaatcaagctctgcgtctgaatttggaga

SEQ ID NO: 291 - DNA, 307 bp, Eucalyptus grandis
gtgatttcgagtcagagcatgcaccttggagttcttgcaactgcctcccatgctgtcacaactcaaactctgtttgtagtttattacaagccaaggactagtcaattcatcataagcttgaacaaatatttggaggctcttaacaataaattcacagttggaatgagattcaagatgagatttgagggtgaggattctccagagagaaggttttctggtacaattgttggggtggaagatttctcacctcaatgggataattcaagttggcgatcattgaaggttcactgggacgaacatgcgtcat

SEQ ID NO: 292 - DNA, 209 bp, Eucalyptus grandis
gttcaatcagctcgacccgaggatcaacaggaagcccttcagcgaggaagaggaagagaggctcttgactgcacacaagctgtgtggcaataaatgggccatgatcgctcggctcttccccggccggacggacaacgccgtaaagaaccactggcacgtgatcgtcgcgaggaagcagagagagcagtccaacaacgcccgcggccgga

SEQ ID NO: 293 - DNA, 224 bp, Eucalyptus grandis
ctcagaagtacttcatcaggcaatctaacgtgtcaaagagaaaacgacgttccagtctgtttgatattgtggcagaggaatcggttgatgtgccaatgggatcaagggacttctttgcggtcgacgagcaacagcaggaaacagaagtaaatgatgccttgcagcagctgccacctgatgttgatgaagaatgtgaatctatggactccaccaactcaaatact

SEQ ID NO: 294 - DNA, 185 bp, Eucalyptus grandis
ttcttcttcttctagacatgaatctcgacatccaatccctcttctaaccaatgggcagccgatgtctggtgaaatcccctgtgctagtattgacagcccatctgttaggactacatctggacctctgggtccttttgataaacatgtgcactcgcttccctatgttgatcccagacagccagttc

SEQ ID NO: 295 - DNA, 428 bp, Eucalyptus grandis
tcagcccgcccctctccgcccacgtggccagccacaaggggctccatcaagcgagcaagcccaagatccacgagtgcaacatatgtgggtccgagttcgcgtcgggtcaggccttgggcggccacatgaggcggcacaggtccgccccgccgccgacggccaccagcgccgacgcgacgagccccaccaacccgccggctgctgcggccatcaccaccgagaagtcccgcaacatcctctccttggacctgaacctgccggccccgaacggaggaggatcaccaccaccaagcgcaccgccgccgggagaactcgaagttccaattcgccacaagtcaacagcccatcatactagcctcgcccgccttggtggattgccactactgaaaaaaaaagaaaagacgggttcacatgtcaatcaatgtaac

SEQ ID NO: 296 - DNA, 418 bp, Eucalyptus grandis
gcagtttcggatattaatttggtttccaatagcacacatagttcatacgaagatgggggaagcccacggagaattacatcagaaagtgaccctaaagatgctccaatgggaactgagagccttttaagtgcacctgaagcagtagagctttcagatacagggacttccttcacgttcaagatggattcatctatgcaaaggaaaccaccagtagatgaaagcccaaggatgcatccgttgcccatgaatctaactactgaagagggagataacaatgtttcgtgccaactaaatctatctcttgcatcttctctactgcaagttgaccacagtcaacaattcaatcgtttgaatgtgctaggttcagaaactagcaagtctccagatgcaaggtcaaatgccagcatcacagaatctg

SEQ ID NO: 297 - DNA, 250 bp, Eucalyptus grandis
tgcacccagagtataactcgagtccagtgggttacatggagaccaacaaggctcgtttggtgttggagaaggacgacttagggttgaatcttatgcctccttcgacttgttaaggttcttggcgatgattatgatatgatgatcagtttttcctgcattatttgaagaagctgaggctgaggtttcttgtcttttctttttcctttttgttatttttgaagaggttttcttttctctatttcccccccca

SEQ ID NO: 298 - DNA, 626 bp, Eucalyptus grandis
agaacataggtgcgaaggccgatgtgttccacatactctctggcatgtggaagacgcccgccgagaggtgtttcatgtggttgggcggtttccgttcatctgaacttctcaagatactagggaaccacctggagcctttgacggatcaacagttgatgggcatatgtaatctgcagcaatcttcacaacaggctgaagatgctttatctcagggaatggaagctctgcagcaatctctcgtggacacactttcttcgaccacactgagtcctactggttcaggcaacgtcgcagaatacatgggccaaatggctattgcgatgggaaagttggccactctcgaaaacttcgttcaccaggctgacctcttgagacagcagacgctccaacagatgcatcggatattaaccacccgccaagcagcccgcgctcttctcgtcatcaatgactacatctcacgtctccgagctctaagttcattatggttagctcgtcctaggactgaaaacatctgttctgctaaactcttctgatgtaatcgatagttttgattgaaattaacgtttctagtggggatccatttactgcgactgtagcgattcgggccacatttatataaaagctat

SEQ ID NO: 299 - DNA, 438 bp, Eucalyptus grandis
aaagaagagactaatggtcgcatctgcattcggagaggacgagaaagcgggtcgtcaaacccgcctaacggtggaggacttgaactacttgtttatggcgtgattcggaaggtctaattttgcggatcgcaacacatcatttactaaccttagtgctgcctggtagagtttgttctgagtagcggcagcggccttatacttagtgatttcgacagaagcgattggctggagattgatcaactttcctgcttcaccattatttgttactgtacagcgcgcgacagatagcaacatctaacagtaaagatgcaatttttttttcccctgaaaatgtaaatgatatagggtttttgttctatctctgtgctctcctccattccttatttgtatacggagatcacaaacttgaggtcagtgaatttgataattatgtcttgc

SEQ ID NO: 300 - DNA, 345 bp, Eucalyptus grandis
ctctcgttcgcgttctccgtctcatccttccttttgccggtgggtttccggtcgagatagcggagggttcctgattcagagggcggcggcggcagcgacgacgaggaggagctccgacctcgaagcgcttcggtccgattcctcccttgcggtcgcgcgtgtctgacggacgagtcgttttttggcgggagatgagagatctgtgcctcgaccagagagaaatggcgtcggggagctccagggtcgaggcccgagctgatgcggagatggcgctctacaacgagctctggcaagcctgcgctggtcctctcgtcgccgtccctcgtcaaggcgagcgtgtcttct

SEQ ID NO: 301 - DNA, 454 bp, Eucalyptus grandis
catattttcatgctgctacgccccgtcctttggcctgcatccatggccaatcagccacccggtgagccccaaccaaatccgccaccgccaccgccaccagccccagcgatccaaatccctgaccaaccaccgcataattcgccttcttcttcttcttcttcttcttcttcttcttcttcattggccaccaccggtgatcggggcggttcctcgcctagaccgatgctttctccgagcgggtcgtcgccgctggctcaatccacagggaggcacccgctttaccgtggagtccggtcccgcagcgggaagtgggtctccgagatccgcgagccccgcaagaccacccgcatttggcttgggacatacccgaatcccgagatggccgccgccgcctttgacgtggccgcgctggctctgaaaggctccgacgccgccctgaacttcccccatgatg

SEQ ID NO: 302 - DNA, 286 bp, Eucalyptus grandis
tttcccgcaagggcacatggaacagctggaggcatcgacaaatcaggaactgaatcagaggattccgctcttcaacctcacttccaaaattctttgccaggtcgtgaacgtccagctcctggcggagcaagaaacggatgaggtttatgcacagattactctaattccagcgggaaatctaatggagcctacaagtcccgatccagtctctgcggaaactccaagaacaagagttcatagtttctgcaaggttctaactgcctctgataccagcacacacggtggc

SEQ ID NO: 303 - DNA, 513 bp, Eucalyptus grandis
cagaggacaaggtaaaaaaggggcagccctctgctctgtctgaattgccgtctctccctacttctctgggcttctttttctttgcttcccttccttaaactctccctctccccgtttcttgtctggtttttctgggtgctctcgcttttcgctgctgaaggagtgagtttgaccgtcgggttcctttcttgatcctccaattcgatcgtcagctcctcgtgtcgacttttttcgggtttcctgtcggcactgttcgattcggattcctcgacggaatggggagtaacatcaacttcaagaacttcagcaccgatccgacgccgacgaataacaggcctcctggcaacacgctgttaacccggcaaccgtcggtgtacacgctgacctttgaggagttccagaactctataggcaaggactttgggtccatgaacatggatgagctcataaagaacatttggtctgcagaggagaaccaatctatggcatctgctagtggcgcttgtggtggcg

SEQ ID NO: 304 - DNA, 370 bp, Eucalyptus grandis
ggcgattgcatgcttcccatgtgtagcatggtgtcagatttttgaactgttaattgcatgtgccgcaatcttcattcctatcaattgagcacttcaacaggctttttctagtgggaagaagtctccaacaaacatgacataggggatattctggaaatagttatgaaagaggagaccccgtttctaataaggaacttccatgcaggcatgtggatcgtacgaatattctgagcaataccatgatgaagttaagccagcatatggacctcagatatcggcacattctcagtatctcgggtacaattccttgagattggggttgcctctcagagtggcggaggaacctgtttatgtgaatgccaagcagtac

SEQ ID NO: 305 - DNA, 503 bp, Eucalyptus grandis
gcccgatgtccccctcccctcccccgccggagacgtgaccgatgccgagtggttctacgtcatgtccttgacccgctctttctcggcgggagacggtattcccgggaaggccctcagcacggggtccttggtctggctgaccggtgctcgcgagcttgagtcgtacaagtgcgaccgggccaaggaggccgagctccatggcatccgcaccatggtttgcatcccgactggtgatggagtccttgaattggggtcttgcgatgtgatccctgaaaactggggccttgttcaacgagccaagtctcttttcggctccgatctgctccttcccaagcacccgccaccgccaccacctccgttccagctccaccatgaccatagcgacatttctttcgctgacattggaataattgcgggcgttcaagagaatgatttcgctcctcacgatgaccacgagaagaaggtcaagaagaagcagccgctggtggaaggagctggcggga

SEQ ID NO: 306 - DNA, 377 bp, Eucalyptus grandis
atgtcgctggaatgacgcgaggccgtcgtgacggcattctgaagagcgagaagacgcgacatgtcgtcaagattggccccatgcatttgaagggcgtgtggatcccttacgagcgggctctcgagtttgccaaccgggaaaagatcaccgagtatctctacccgctgtttgtgcatgacattggcgcgctgctctatcatccgagcaaccccagcggcgccaccagccgtgcgggcaacgcgcagaacacgcttgccgccatcgatcgtcgcaggaacgaggcgcgcatggcggcaagcatccaggggcaggcggtgagcggagtattggtctctcccgtcgcccagaccgcaggcggccgacccagcgtcgaccgc

SEQ ID NO: 307 - DNA, 361 bp, Eucalyptus grandis
aataatctctctctctatgacaatggagtgggtagtacaccacgccccaggtcaaatgctgaacagttaattttccgagcggcattgcaggatctctctcagccaaaatcagaagaaactccacctgacggtgctctggcagtacctcttttgaggcatcagaaaattgccttgtcatggatggtgaaaaaggaaaccgccataaattgctgtgggggaattcttgcggatgatcagggactagggaagacagtatcaactattgctcttatacttaaggaaagacctccaaccttcaaacaatgtcaggagaatccaaagcaggagttacaaacttttgatttggatgaggatgaaaatg

SEQ ID NO: 308 - DNA, 357 bp, Eucalyptus grandis
gccctctacctctccccctccctctctccctctacacctcgctctcgcttcatgatctgggtggacagagggtgttcccgcatagatccatcactcgctcgtgttacttcggcgcaaaaaaggctttgttttgggacctgggtttgtgtcgattggtcgtttttgtgaactcccgaatagtgatgtcgttgtcggccaagagcgagtcgattcaaattcgggacgtgtgggatgataacctcgacgaggaattcgcgcgaatccgcgagatcgtcgacgattatccgtacgtggccatggacaccgagttcccgggtatcgtcgtgcgccctgtgggcaacttcaagaactccagtg

SEQ ID NO: 309 - DNA, 433 bp, Eucalyptus grandis
ccgcggtcttctttcttccaaagtaaactcaacttcttccttcctccccaccggcaagaaaagtctccccgatcctctctcgccattcccggcctcgccgtccggctgaattgtcgacgttccggctcgctccggcgccgactggaggccatggcggattcggacaacgactcggggggccacaacaacgcgaacagcgagtcggcggcggcgctcgcccgcgagcaggaccggttcctcccgatcgcgaacgtcagccggatcatgaagaaggcgctccccgccaacgccaagatatccaaggaggccaaggagaccgtgcaggagtgcgtgtcggagttcataagcttcataacgggggaggcgtcggacggcagcagcagcatcggcggcggcggcgggggcgtcgtgaacagcggcgggggctccgcgg

SEQ ID NO: 310 - DNA, 511 bp, Eucalyptus grandis
ggaagatcaatccagatcgatgggagtttgtgaaccaaggttttcagaaagggaataagcacttgctgaagaatataaagaggagatgcaaattcagtgagcatagaaaaacatcgagtagtactgtcacctctgattaccagaaagctgaaaatgaagtggaactcaacacgcttaagaagggccaggaagtgttgaagaccagatcccttaaactaagagaagagcggaagagctttcagcatgagattgagcaagtcgcagagcgggttcgccatgctgagtgcaggaaccagcagatattcctcttcctcacaaaagcagccaaaagccccaactttgtccatcatttaatccagaagaagagccagaagagagatttagagacttgtgaatcaagcaagaagagcaaattgcttggttccgatgctgaagccaccaaattcttgaatgaagcaatggatcacatgattaaaagcccaaacgttgattgcctgagaatcagtgatga

SEQ ID NO: 311 - DNA, 799 bp, Eucalyptus grandis
ggaattcttgcagctgcagctcatgctgcggcgaacaacagccctttcactatattttacaatccgagggcaagtccttctgaattcgtgatccccttggctaagtacaataaagcattttatactcaagtttctcttggcatgagattcagaatgatgtttgagaccgaggagtcgggagtccgaagatacatgggtacaatcactggaattagtgatttggattctgtgagatggaaaaactcccagtggcgcaatctccaggtggggtgggacgagtcgacagccggtgaacgaccaagcagagtttcaatgtgggaaatagagcctgttgtaactcctttttacatatgtccacctcctttttttcggcccaagtttcctaggcaacctgatgatgagtctgatgtagaaaatgctttcaagagggccatgccttggcttggagatgagtttggcatcaaggacacgcctaactcaatcttccctggcttgagtttgatgcagtggatgagcatgcagcagagtaatccacttcaagccactcaatctggacttctacctccaatgctttcttccactggtttacacaataaccttggcatcgacgacccctccaaattgctaagtttccaagcccccacccaaggtcttcaatttaataaaacgaatccacaaaatcaagtcagtcaattgctgcaaccgtctatggcttggtctcaacagcaccagcttcagcaactgttgcagaatcctctgggccaccagcagcagcagcagcagcagcagctgcagcgcc

SEQ ID NO: 312 - DNA, 304 bp, Eucalyptus grandis
gtaccttccatgaaaccagaatatccggttccaaatggaattggagcatcggactttggggaatctttcaggttccagaaggtcttgcaaggtcaagaaaacttgggttttggcactccttacgatggtatcgaaactcaaagtcatcggctatctgaagtgaggaggcatcatcctgatgattcaggtggttctgaagctgctgccaccagaaatggcatcacaaacccatccgtgaatgctagtgtcacttacaaaggcatgggctttggcgaatctttccggtttcgtgaggtcttgcaag

SEQ ID NO: 313 - DNA, 427 bp, Eucalyptus grandis
cccccctctccccttctgcctccgccctcgatccccaaaaccctcctccgaatcgattccggcagccccctccggccaccgccccctcccgccgcaatggacgcagcgccgccgggcggcggcggaggcggaggcggcccggcgccgttcctcctgaagacctacgagatggtggacgacgcggggacggacgagatcgtggcgtggagctccggcaagacgagcttcgtcgtctggaacccgcccgagttcgcccgcctcctgctccccacctatttcaagcacaacaacttctccagcttcatccggcagctcaacacctacggattccgaaaaattgatcctgagcgatgggagtttgctaatgaagaatttgtgaaggacaaaaaacatcttctcaaaaacatccaccgtagaaagcccatcc

SEQ ID NO: 314 - DNA, 308 bp, Eucalyptus grandis
ttcaagatgtaaagggaaaggaagtgggtgtttcagttcagattttggcccaataataacagcagaatgtacgtgttggagggtgtaactccttgcatacaatctatgcagttacaagctggagacactgtaacttttagccgcatggaccctgaagcgaaacttataatgggtttccggaaagcatcaacctctatgatgcaggacagccaactagctgctgtttctaacggtaaccattcaagtgaagctttgatttctggtggttttgaaaatgtacctatgataagtgggtattcgagtctcct

SEQ ID NO: 315 - DNA, 92 bp, Eucalyptus grandis
agaactggaaaggctgaatcagagtgtctttgtccccgtaatagtgggctgctggatgcgttagttcacgagtcgaagactatgagcagtgc

SEQ ID NO: 316 - DNA, 764 bp, Eucalyptus grandis
agagagacgaccggacggtggaaaagagagagagagagagagagagagagagagaagattgcgatgtagccggcgacgatcctagaatctgaagctgccgagcctaggccgtcgattttcttaagcccgttcttggtgctgctgttgccgttgctgttggtggtggtggtgctgctgctgctgcagtgattgcttcttccagctttttctgtggcggaatagagctgcagctcgtcgggggctcgtctgctcccgctgttcccttcccctccccgtctcctgagtagggttgcggaagttttccggcggtccgtctgcgcaccaccgatcgacgaggaggcgcgctccgtcttcggattcgggacgccggggatatggcttctcacgaggtctccgtcgtggggagcgaccggagggagagggagaggacgggctgcgaggacgccttgtacaaggagctgtggcacgcttgcgccggtcctctggtgacggttcctcgcgaaggggagctggtttattacttcccgcagggcatatcgagcagattgaggcgtcgatgaatcaagtcgccgatcggcagataccgttttacaatcttccctcaaagattctctgccgtgtcattaatgttcaattgagggctgaaccagagaccgatgagctgtttgctcaagtgactttgcttccggtgcctaaccaagatgagactgctgtggagaaggaaactgggatcccctgcctccaacgaccccgtgtccattcct

SEQ ID NO: 317 - DNA, 181 bp, Eucalyptus grandis
acattcatggggatatgcagcctccaacattcatctcagcaggcggaggaggcgctgtcccaggggctagaacagctccaacagtcactcgtcgacaccattgccggcgggcccagcatcgaaggaatgcaacagatggcaatcgccttgggcaaattaaccaatctcgaaggctttgttc

SEQ ID NO: 318 - DNA, 420 bp, Eucalyptus grandis
ctattggttatcccaagatgccgttacaggcttcaatttctacacagtcggacttccaagctgatggttctggtcatggtgtgccaataccacaaggtgcagatagtggatcattaggcatttcagccttacccaccatacaaagagattcgggtgtgcatgttaagcaaacaacaagtgagtcatcgagggaggattcagatgatgaagaatttgaaggtgacacgggaaccactgaaaacaaagatcctgctgaagtcagacgcgccagaaggatgcagtcaaatcgggagtcagctaggcgatccagaagaagaaaacaggagcacatgagtgaacttgaaaaccaggttgagcacactggactactgaagcgtctcactgatatgaaccaaaagtatgatgtagcatcagttgaca

SEQ ID NO: 319 - DNA, 462 bp, Eucalyptus grandis
cggaaccggtggcaattggatcgctcttcctcgcaaagccgggcttaagcgctgcggcaagagttgcaggctaaggtggctgaattacctgaggccagacataaagcatggaggtttcactgaggaggaggatcacgtcatctgcactcttttctttaccataggaagcaggtggtcggtaattgcttccaaattgccaggaaggacagataatgatgtgaagaactactggaacaccaagctgaagaagaagctaatgaagcaactggcttctctgaaaacagtgcctgaaagtaactttgactatcaggtctgcgcacagaactcggcctcaatcgatcctgagaccaagaatcgggaatatgctgctaattcaatgggattccccaagcagaacttcaatccaggaatacccacttcgaactcgagtcttctctgtcctccaagtctcactgaagtttc

SEQ ID NO: 320 - DNA, 445 bp, Eucalyptus grandis
gcacttcttgcgcagacaattgcagactctctctctctctcattcaggcgcctgtcttctcaagcattttgtcaaagaaactcctttgttttttctctctttctctctcgaccatggcccgaccgcagcagcgatatcgcggcgtgcgccagaggcattggggctcctgggtctctgaaattcgccacccgttattgaaaacaagaatttggctagggacgtttgaaacggccgaggatgcggctcgagcctatgacgaggcggcaaggctaatgtgcgggccgagggctcggaccaacttcccttacaacccaaacatgtctcagtctcttcgtcgaagctcctctcggcgacattgacagcaaagctccacaggtgctacatggcctcgttgcagatgaccaagtctgcattgcaagtgcaagaaccacagaaccacccagtt

SEQ ID NO: 321 - DNA, 350 bp, Eucalyptus grandis
cgcgagccgcatcccgcccctccttccttccccgttctcgaattcgccgagatctgctgcggatcgcaccggcgcgggattctcgatggaggcggcggcggcggcggcgaaggtggtgggggaggcggaggagctccccaagaccatcgtgcggcgcgttgtgaaggagaagctctcccggtgctccgacgacggcgacgtctccctccacaaggacgccctcctcgccttctccgagagcgcccgcatcttcatccactacctctccgccacagcgaacgacatatgcaaagaatcgaagaggcaaactatcaacgcggatgacgtgttgaaggcgctggaggagatgg

SEQ ID NO: 322 - DNA, 263 bp, Eucalyptus grandis
tggcgatagccagttcatgagcaaggccagcttcgtggtgttgataggttggagggtagtcactgggtaccaattgggtgggaaaggatctcggctctcgcccaaactgtgcaagtagatgctggttgggggatgcagctagattcaatggatgacgatgaggacctgactgttgcagatatggagactccttactgggagaggcctgcagggccgatatggtggtgtcatttctcggcaggtcatcctgctgtggaagcatg

SEQ ID NO: 323 - DNA, 893 bp, Eucalyptus grandis
gttttttcccttttcgatatctctgcaaatctgcgactctctgctctcggctccaaccccctcctcttcactcttcttcacaatccctgtctcgcgaatttatggcgctacccgcacgacagtccgtcccttcctttgatcactagcaaatgtacgaccgaggattagcaacccaaaagctgtcgaattccatctgatttggtgcctctcatggtgtgaaaagcagaactgttctctcgtattcttggcatcagtacaactggctcaacatgctgttactcttactcaactaaaacttcagcaccacattgtcgttggccttaaagttacagctcagtaatgaaaccaaccattgatctggaagtggaggccgtctcggaaaatgactctgagattagtagccaagtcgcctccaatctatccaatcaagagccctccatgggtccctccaatgacagccttgctaactcttcctacctcatcagcccttcggctgttggatcaggttccgaaactgtgttcctagacttgagccttggttgcagcaatgatgagtccagcgggagggattctgtaggagtcgccttctcgagcaccagcgaatgtagcaatgagcccgaatctcatccggcagctgcaggaccaaccacttcaagagtcttttcttgcaattactgtcaaaggaagtttttcagctcacaggcactcggtggccatcagaacgcgcacaagagagagaggaccctggcaaagcgggcaatgaggatgggcatgttttcttcacagagatattccagcttggcgtctttgcctttgcacgggtctcccactgtcagggatctggggatcaaagcgcattcttccgtgcaccaggtgcaccaaggcatgttgca

SEQ ID NO: 324 - DNA, 434 bp, Eucalyptus grandis
atcacttcaacaccatgaccttacaaaaacaaagcaattgttagaaccatggttgctcaactgaagaacttcgatgctgcgctacaagaattggaggagaagaagaagaacgaagtcgaccctagctcgagcatcggttcgtggatgtggaaccctagtgccgcccaggaggatgatgactcgtgggaggtgagagccttcgccgaagacactagcaacattatgggcgcaacctggccgccgaggtcctacacttgctctttctgtagaagggagttccggtccgcccaagccctcggcggccacatgaatgtccaccgcagagaccgtgctaagcttcaccaatcacaattccggccgctggcgaaccaaaattctcctttcgcttcttgctcttccccgtcctcctcgactctgctattcccgaatcaaga

SEQ ID NO: 325 - DNA, 588 bp, Eucalyptus grandis
cctagctgaaactattactcccactggttctctctctctctctctctctctctctcaaacatggctgaattagattattgccaaaccaaaagcagccccggcgctgccgccacgcgcttaaagctcttcggcttcaacgtctccgatgaggaagactcagccgtcagcgaccccattactgttggcgcgaacggcggcggcggcggcggaggcggcaaggccacgccgtcgggctcgccggaaggcagcgtcccggtggggggcggcggcgagcggaagtacgagtgccagtactgctgcagggaattcgccaactcgcaggccctggggggccaccagaacgcgcacaagaaggagaggcagcagctcaagcgcgcccagctgcacgccagccggaacgccgccgtgtcgtcgctcgtccggaaccccatcatctcggccttcgctacgccgccgcacctgctggccaccgtggggccggtggtggtgacgggggcggcgcccacctccccgtcctgggtttacgttccgcgtggcgccccgcccttccaagtgtcgcacggctgcgtgttcacgaccggccaggga

SEQ ID NO: 326 - DNA, 417 bp, Eucalyptus grandis
ggaacatcaatcgaatccatggcatcagagctcctcagccgctaatcacaggcagctcaacctagagctcgcacttgagccatgttcaccatcctcgtcatcatcaccagcatcactccatcctcttgcagttcctgcaaaagacaacaagctttactcatgcaacttctgccaaaagaagttctatagctcgcaagcacttgggggtcaccagaatgctcacaagctcgagcgaaccctagcgaagaagagcagggacttgtgctctgccgcaaaacctcctgcggcgacctcgaatggtcaccatgtacggccatcttttcaatctgtggtttatgagaatcagccacgcttggccaggcatgttggggatgatatgaggtatgctgggactaatccgctgtatggttcatcttg

SEQ ID NO: 327 - DNA, 448 bp, Eucalyptus grandis
cagctgtcgtcggtggacagggaagcgagggtcctgaggtacagggagaagaggaagaaccgcaagttcgagaagaccatcaggtacgcctcgcggaaggcctacgccgaaacccggccccggatcaagggcaggttcgcgaagcgcgccgacatcgaggcggaggccgagcgcatgttcgggttcggggtcgtgccctccttctgatgtcatctgaagcgttggaaggtctctctctctctctctctcaagagagaaattttgggctcttttccttgctggttttgtgctgctgcttttctcttgcagcgatatcagtctgttttgtatatacagtaggagactgttgtgtgctccctggatctctgaccgttgcctgatcttgaatgttttatggtgaattttcatggaatttgatgatgcaaattgaagggaaatttgctgaaaa

SEQ ID NO: 328 - DNA, 673 bp, Eucalyptus grandis
gagaggtccgtggacggtggaggaggacctcaccctcgtcaattacattgccaaccacggcgaaggacgctggaactccctcgcccgcagcgcaggtttgaaacggaccggaaagagttgccggctgcggtggctgaattacctccgccccgacgttcggcgcgggaacataaccctcgaagagcagctcttgatcctcgagctccattcccgctggggcaatcgatggtcgaagatcgcgcaacacttgccgggcaggaccgacaacgagatcaagaactactggcgaacccgggtgcagaagcacgcgaagcagctcaaatgtgacgtcaacagcaagcagttcaaggacgccatgaaatacctctggatgccgaggctggtcgagaggatccaagccgcctccgcctctgtctcgaccgctactgtcgccgccgccgccatggcagccccacccacaatggccaccaccgcagcatccaacatcggcggcatggctttcccgccggccctggcgggcatgggcggcgacttcaggggcgggcgagtgaatgtggcgcccagctacagcaccccggagaactcctgcacgacggcgtcttccgactcattcggtgcgcaggtctcacccgtctcggaccttaccgaccttgaccgagtacttaccctatcc

SEQ ID NO: 329 - DNA, 1008 bp, Eucalyptus grandis
gttccaagttcactcccttcctcaagctacgattccagctctccggaaggaggaagaacgtcgcgaaattcaccggaatctctccgacccatcaacgctcgggaaggaaaggcgcgacctttgatccgccttttttttgtaccgtccgatgagtctctgggcggactacgaccacgccgccgcgaccgacctctccgccttctggccgccgccggccaccccccctccgccggcgccggcgccgccgctcagtcaggagtcgctgcagcggcggctccaggccctgatcgagggggctcgcgggagggacggggaagaaggggccggggggcccgccgcggcgtggacctacaccatcttctggcagtcctccggcgactactccggccccgtcctcgggtggggggatgggtattacaagggcgacggcagagccaggagcaggggctccgcttgctctcaggccgagcaggagcaccggaagaaggtcctccgcgagctcaattcgctgatttccggggccccgcccgccgacgacgcggtcgaggaggaagtgaccgacaccgagtggttcttcctggtctccatgacccagtcgttcgccggcggcgtcgggttgcccggtcgggcctacttcagctcgaatcccgcgtgggtcacgggggccgagaggttggggaattgcgggtgcgatagggcccggcaggcgcagatcttcgggttgcagaccatcgcgtgcgtccctgttttgaacggtgtggtcgaactgggttccaccgagccgatctaccagagctccgatctgattagcggaattagggggctgttcaatttccatgaatcggagatgggatgcggtggtagggttttgaatagcgagcatgacccggcgtcgctttggatctgcgatccgccagtcacgatggagattaacgatcgtcctatgacatttcagatagagaaccccagctcgagcagtcttaccgaaagccccagcgcgatctgcgc

SEQ ID NO: 330 - DNA, 384 bp, Eucalyptus grandis
caaaccccaccctgataagttcccagcaacatagagacactcacagaaacactcgcaaaaaacctctttgctgtcttccatggttccgccattcccgactgcagaactgcctctcaacgagaatgattcgcaagacatggtcatctaccatgtactgaacgaggccatgtcccagaacaactcctccctcccgcatccgaaccaatctgggtccccatcgagcggcggttccctcgagccgtccaggggcatcacgaagaagcactacagaggagtccggcggcgcccgtgggggaagttcgcggtgagattcgcgactcgttacgccacggggcccgagtttggctcgggacattcgagacagccgaggaggcggcgctggct

SEQ ID NO: 331 - DNA, 420 bp, Eucalyptus grandis; identical to SEQ ID NO: 318

SEQ ID NO: 332 - DNA, 1439 bp, Pinus radiata
gcaacctgaagcgttttaggcggtgaggtggaagaagggggacaagggagaacctgaagatttgtttgaattaagctgtcatcgggcagggcaagcaggtcttcatatctctgcaatatatatctatatgcggcagaccttgtttaggcaatctattgtttcgggtataagtagggaagtttccccattctgtaggattcttaaacgcatttctagggccacggaatgcgtcaaattgcacatacccacgcctcctttctcataacaggtttacgcgcgatttcttcccttctagaaggcctcttcctcctttactaaatcgggtgttgtttcatcagttttctccacaaaatccctgaagttctcttaattttttcgagggtcggttttttatagtgttatctacggttaatatcagcgaagggcctttagatccgaaggtataatggggcagcaatctctgatatacagttttgttgcgaggggcaccgtggtgcttgcggagtacacggaattcaaaggcaattttacaggtattgccgctcagtgtctgcaaaagcttcccgccagcaacaacaagttcacatacaattgcgataatcataccttcaactaccttgttgaagatggcttcgcatattgtgttgttgcagatgaatccgttggaaggcaagtaccaatggcatttctggagcgtgttaaggaggattttaagaggagatatggtggtggaagagctgacacagctgttgctaacagcttgaacagagattttgggtcaaaattgaaagagcacatgcagtattgcattgaccaccctgaagagatcagcaaacttgcaaaagtcaaggcccaggtttctgaagtgaaaggtgtcatgatggacaacattgaaaaggttcttgaccgtggtgagaagattgaacttctggttgataaaacagaaaaccttcgttttcaggctcaagacttccaaaagaagggaaccgagttgcgcagaaagatgtggtttcagaacatgaaagtgaaattgattgtccttggaattgtggtggccttgattctcataattgtcctttcagtatgccatggattcaattgttcgaaaaaatgatctggaatagatagaggtccatttgaattggaacaacttttgattggctatggatggcattcttgttctcctttgtatttctctctatattatcagtttcgggtgagatagttctatgatgtttgccagagggtattttgcttggacaatcactggttgatagtacatattgactagtatgacaacgaaatgttctgaatattcagtggggcagagactctgattgcgtacagcaactttagtgtattatatcaaggtcatgcatttgttattgttcttatctttaatgaagtattgttttacatcttagaaaaaaaaaaaaaaa

SEQ ID NO: 333 - DNA, 407 bp, Pinus radiata
atttaactgggattgcaagctgcttgtgttgtttctgtgcttcaagcgaagggaagggaagacattcctagagaagaaaaaaatcaatatcaatggggagggggaagattgaaataaaaatgattgaaaatacagcaaacaggcaagtcacattctctaagagaaaaggaggacttcttaagaaagctcacgagctctccgttttatgcaatgcagaaattgctctcatcgttttttccaacactggcaaactccatgattggtcaagctccagcatgaaaaaagttatggagaagtaccagaaatcggatcaaggactaggacttatggactaccaacaacaacagctgttgtgtgaaatgaaacgaatcaccaaagaaaatgaaagccttcgagctcgtttaagg

SEQ ID NO: 334 - DNA, 307 bp, Pinus radiata
gtaccgtctccactggtgcctacccgagaaaattacttcgtgagatattgtaaacaacattcagatggaatatgggcggtggtggacgtctctcttgacacgttgcgtgggaacccgcaaccccatcccaactgccctccttcgactttaagatgccgaagacgaccgtccggttgccttatccaggagatgcccaatggctattccaaggttacgtgggttgaacatgttgaagtggacgagagggctgtgcaccgtatttatgataagttggtaagcaccgtttcgcgccgaacgccataccgct

SEQ ID NO: 335 - DNA, 530 bp, Pinus radiata
ctttccaatattgagcccaagcaaatcaaagtttggtttcagaatcgaaggtgccgagagaagcagaggaaggaagcctcgaggcttcagactgttaacaggaagctgacggcaatgaacaagttgctcatggaggagaacgatcgccttcagaagcaagtttcacagttggtgtatgagaatggttacatgagacagcagctacagaatgcatctgtggccgccacagacacaagctgtgagtctgtggtgactagtggtcagcaccaacataatccaacacctcagcatcccccaagagatgctagccccgctggactcctgtctatagcagaggagaccttgacagagttcctttcaaaggctaaaggagctgctgtcgattgggtccagatgcctgggatgaagcctggtccggattcgattggtattgtagctatttcaaatacttgtaatggagtagctgcacgtgcttgcggtcttgtaggattagatcctacaaaggttgcagagatccttaaagatcgccc

SEQ ID NO: 336 - DNA, 402 bp, Pinus radiata
cattcttccagagggaccacctgagagccgatcagtaattgacaatcgacaggtcgaaggatcgatcctgaccattgcatttcagatacttgttaacgatctcccatcggcaaagctgacgctggagtctgttgagactgtcaacaatctcatttcatgcactgcacagagaatcaaagctgctctacataaagtcgaggatgtttgatgttcagagatcggtcgcaagctaacttaaatatgtcttcaattatttttttttaccaaaacaataaatattatttatgagtgttgaacaacaccattctcgagttttgggattgtatattatcagtttgaaagtgtgagtgcaatttgataaccgactatagggatggaaggaaaactgcatcgaaatccaca

SEQ ID NO: 337 - DNA, 356 bp, Pinus radiata
attttttctgtagatggtgtgaggacgtgctgaatagttcctaaatcgtttcttccgcgtttggtcatcgaacgagttcctataactcgccaagaccaggttcttcacggactactaattttgggcttctacacatctttcccggaagtagatggggcgggcactaggaagaacagaaataaagaggatagaaaatgaagtgagcaggaatgtgagttttagaaagagacgacgtggattgctgaagaaggctgcggagttgtcaatactttgcgatgcaacagtgggcgttgttgttttctctccggccgggaaactttctgaatatgccagcacttcggagtcaaatggatacg

SEQ ID NO: 338 - DNA, 380 bp, Pinus radiata
attcgaaaccctaccaatcggcactcatccttctacaaacgcaagggcggtttgcttaaaaaagcatttgaacttgctgttctctgtgatgctgaagttgctctgataatcttctctgaaaccggcaggatttacgagtttgcaagccacgatgatgtgaccacagtattggcaaaataccgaatacaaacgaaaactgccggaaacgcaatgccttcatcgcttcaaaaaacagagtttgatcaattacaagtcaggatgttgcaggagaagatagacaatttggagaaaacgaaaaagcatatggtcggtgagaatttggagtcactgacgtggaaggaattgcaacaagtcgaaaagaaattaagcaaggctacaaa

SEQ ID NO: 339 - DNA, 299 bp, Pinus radiata
cctacttggaaaggcaaatccttgtaactgttccatcctgcacgaattggaggttttggaggtggccaggtcatcctcccattagcccatactgtggaacatgaagagtttttggaggttatcaagttggagaatcatggcctgacacaggaagaagctttgctatcgagggatatgtttctgttgcagctttgtagtgggctcgatgaaaatgcagttggggcctgtgctgaacttgtctttgctccaattgatgcatccttagctgacagttctcctttgctcccttctggtttcag

SEQ ID NO: 340 - DNA, 584 bp, Pinus radiata
tcgcagcgtaaagcgttcatgggtgccgggcgggtaactcttgaaaaatattagattcgactccctgaccctgggaggaggaagaagaagaagaacagcaggaggaagcgaaaatttcttaatagtaaccagagaatagcagcgggtgaagaagcagagggatcttgcaatggggcggggtcgggttcagctgaggcgaatagaaaacaaaataaatcgacaagtcacgttttcgaagcgccggaacggactgctgaagaaggcgtacgagctatcagtgctgtgcgatgccgaagtggcgctaataattttctctaccagaggaaagctttacgagtttgccagttccagcatgaacaagacgttggaaagatacgaaaaatgttcatatgcaatgcaagataccacaggcgtttcggaccgggaagcacagaattggcaccaagaagttacaaagttgaagggtaaggttgagctcctgcagcgatcacaaaggcatttgttgggggaagatctgggtccgttaaatgttaaggagctacagcagcttgaacgtcagctggaggttgctctgacacatctta

SEQ ID NO: 341 - DNA, 592 bp, Pinus radiata
ttgggttcggggtcctgtcctgactggaatttttgtttcactcgttctgccccgtctggattgggctgcactgaaatacattgaacattggagttgtcgagcgcgagatatgggtcagcagtccctcatttacagctttgttgcaaggggcacggtggtcttggccgagtacacccaattcacgggcaatttcacaacaattgccaatcaatgccttcagaagattcctgccagcaataataagttcacctacaattgcgatcgtcacacattcaattatctcgtcgaagatggttacacatactgtgttgttgcagatgaatcagttggaagacaactaccaattgcctttctggagcgcattaaggatgacttcaagaaacgatatggtggtggaaaagctgacacagctgttgctcacagcctcaacaaagactttggaccaaaattgaaagatcatatgcagtattgtgttgatcacccagaagagattaacaaacttgcaaaagtgaaggctcaggtttctgaagttaaaggcgtaatgatggagaatattgagaaggtccttgatcggggtgaaaagatagaactt

SEQ ID NO: 342 - DNA, 163 bp, Pinus radiata
gtttcctactggaaatggtggaacaatcgagcttttatacatgcatacatatgcggccactactttagcttctgctagagacttctggactctgagatacacaacagtgttggaatatggtagtcttgtggtttgtgaaaggtccttgagtgggactcagggt

SEQ ID NO: 343 - DNA, 372 bp, Pinus radiata
gaggagggaggcctgctgccctcagccgtccttaatggcgagagctcctcaccaccaccagcaacagcaacaccaccagcaccaccaacaagaagccagcaggatggtgacttccttggaggtcgatatcgatactgcttgttccagtaaacctaacgattccattgatgcgctgaaatcaaaaattgcttgccatcctcactatcctcagctgttggcagcttacatggattgccagaaggttggggctcctccagaagttgtcacagtactggatgagattattcaagagaatcagcttggacgccattcgggaactatggatataggagtggatccggagcttgatcaattcatggaggcctactgcca

SEQ ID NO: 344 - DNA, 418 bp, Pinus radiata
gtagattccttgtctatcaagagggtgcacaaggtttgtttttaagaacacagacaggcagacagacagagacgtgatcatggggcgagggaagattgaaataaagaaaatagatgatgtaacgagcagacaggtaactttctcaaagcgcaagatggggatattcaagaaagcccacgagctgtctgttttatgcgatgcagaggtggctgttctcatcttttcaaacaccggaaggctctacgactatgctagttcaaggtgtatggaacgaactattgagagatatgaaaaatgtaccaaagcaattaattgcccaacatcagatcccattgtcgagaataagagcccaattcaggaaggcattgaaatattgaggcagaaacttcgtgcattacaaagattgcaaagaaatctg

SEQ ID NO: 345 - DNA, 657 bp, Pinus radiata
ggtacaagaagtggctcatattgcaaatgggtcgcacccgggaaattgtatttctcttcttcgcgtaaatgcatgtagtacaagccaaaacgtagagctaatactgcaggagagttgcacagatgcatctgggtctgttatagtgtacgcccccgtggacgtcccagcaatcaatattgctatgagcggggaggatccttcatacatagcccttctcccctctggatttgccattcttccagacggtcaaaatagatcttctactagttcactcctcgaaggggcgaacagcagcagcaacagtagcaacagcagtggattggatagcccgctcacaagaggaggttcattactcactgtggcctttcaggtgcttgtcagccatttaccaacagccaagctgggtttagattctgttacaaccatcaataatctcatatgcaatacagtgcagcagataaaatctgcattgcactgtgcagatgtctgaatcgcagtgtaattatcggagtacgggtggagggggcggcatgcagagaaacaacataaaaaacgttctatccggtacttgcacccccaagggtagtagaataaaaaatgatatgcatatatatgtttggtggttgctttctgtagttttatctgctgcagttaagt

SEQ ID NO: 346 - DNA, 377 bp, Pinus radiata
aaccggagagcaagaacaaagtggaaacgcaacgaagtggagtgcgataatctgaaacggtgttgcgagagtctgagggaggagaacagaagattggagaaagaagtgcagtcgctgagagccatgaaagtcccgcagtcacccaattcgatgcctctggcagccgccaccctcgcaatgtgtccggcctgcgagggccttgcaatcaagaaccgcggcgccgccacttcctccaccgcgaagtcacaacaatccctccttacaattatggggattggggatgtaaatatgatatccaaaaataaccaaaccccttcaatgggaatgggagatgaaatgaattgaagaaagtgaacttaaaaaaaaaaaaaaaaaaa

SEQ ID NO: 347 - DNA, 558 bp, Pinus radiata
gaaagaaggaaagaatggggcgagggcgcgtcgagctgaagcggatcgagaataagattaaccgtcaggtcacgttttcgaaacgccggaatggtctgctgaaaaaggcgtatgaactttcagtgttatgtgatgcagaggtagcacttgataatattctcaagcagaggaaaactctatgagttcggaagcgccgggatgctcaagactctggagcgatatcaaaaatgttcatacgtattgcaagacgcgactgtatcggaccgggaggcgcagaattggcatcaagaggttggcaaattaaaagccaaagttgaacttttacaacgatcacaaaggcacttattaggtgaagacctgggccccttgagtattaaggagctgcaacaactggaacgtcaacttgaggttgcactgacacatgttaggtcaagaaagactcaagtcatgttggaaatgatggatgaactacgcagaaaggagcgaattttacaagaagtaaacaaatctctgcgcaagaagttgcaggaggccgagggacaggcattcaatgccatg

SEQ ID NO: 348 - DNA, 331 bp, Pinus radiata
ctcagatacagctaatagcagtgagcttctgggcagcagcagatcagatggagatcacccacatcatggccaccatgatcagcagcagcagcagcaggagaatcatatggtgtggcagaattcaaggctcaaggcagatgttctccaacatccactgtatgaccagttgttggctgctcatgttgcctgcttgaggattgcaactcctgtggatcagcttccaaaaatagatgctcagttggctcagcagcaccatgttgtggccaagtactcagtcctaggaaggaaccagctcttgactggagaggagaaggaggagcttgacaggttc

SEQ ID NO: 349 - DNA, 260 bp, Pinus radiata
acgaaattaccttggggagtatactggagagttgatttcacatcgggaagctgataagcgaggaaagatttatgatcgagaagactcctccttccttttcaacttgaacgatcagtatgttcttgatgcataccggaagggggataagttgaaatttgcaaatcattcaccaactccaaattgctatgcaaaggtgattatggttgctggtgatcatagagtgggtatttttgcaaaggaacgcattgcagccggtgagg

SEQ ID NO: 350 - DNA, 479 bp, Pinus radiata
aaaatttaacagaaacattgcaagctgcttgtttaatttctgtgcttcaagggaaaggagaggaagagattcccagaggagaagatcaagataaatggggagggggaagattgaaataaaaatgattgagaacgcaacaaacaggcaagtcaccttctctaagagaagagggggacttaaaaagaaagctcaggagctctccgtcttatgcaatgcagaagttgctctcatcattttttccagcaccggcaaactccatgagtggtcaagctcgagctcattctttatgttacaaaaaagcatgaagaaaattctcgagagataccagaaatcagagcagggactaggactcatggattatcaacatcaacagctgttgtgtgaaatgagacgaatcaccaaagaaaatgaaagccttcaagagcgtttaaggcatatgaatggcgaggaagtcaattcattgaagctcccagagcttt

SEQ ID NO: 351 - DNA, 260 bp, Pinus radiata
gctatttgcagcatttccttccatccgtacccaaaagatgctgacaaacatttactagcaagacagactggactgaccagaagccaggtttcaaattggtttataaatgcacgtgtccgcctttggaaacccatggtggaagaaatgtatatggaggaacttagagaggccgaaacacagaatcatgcagcagattcgaaggtaacaacagaaagtggtcaaaacaatgaagaaacggtgtcaaaggaaggagctgggaa

SEQ ID NO: 352 - DNA, 176 bp, Pinus radiata
agggggctggttacagctctgtgagcggaatagatgaacatgcagctggattctgttctcaacttgtgtttgcaccaattgatgcatcttttgctgatgatgctcctctggctgccctctggtttccgagtaattcctctagaatctggatcagaatgtttctcctccaaaacgga

SEQ ID NO: 353 - DNA, 338 bp, Pinus radiata
ggacggaggaggacgaggagctggtcatttcgtcatggaacagtttatacctgagcaggccgtcatctctgattcgtccatatcttcggtgaaaacagaagtttgcagcggtagtggaggccaatttgagctgatccgcaggaaagaagaggggagatgcggccgtgcctatgctgagccttcatttgttgtcactcctctagttacttcattacctccacagcagcaggaaggccggatggtaacatccctggcagtggatatggacagctcatgttcttgtaaaccaaatgaagctgatgccatgagagcaaaattatttgcgcatgtacactatc

SEQ ID NO: 354 - DNA, 405 bp, Pinus radiata
gggcaaggggaaagacacagatgagaaagatcgagagcgcgaccagcaggcaggttacgttttctaagcgcagaaatggattgatgaagaaagcttacgagctgtcggtgctctgcgatgcccaactgggactgattgttttctcccccagagggaaggtctatgaattctccagtacctgcatgcagaaaatgttggcacgatacgaaaaatgttcagaaggaagtgacacgagtacatcaaaagagcaagatgtccagtgtttaaaacgagaaagtgcgaatatggaagaaaggattgaaattcttgaatccatgcaaagaaagatgttgggcgaggagctggcatcatgtgcattgaaggatttgaatcagttggagagccaggttgaacgaggtttgagaa

SEQ ID NO: 355 - DNA, 332 bp, Pinus radiata
tctctctggtgtggggagcactcaaaatggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacacatggaaacatggagtcctcgtcggtccaaagcgtgaagattggtgaatcacaactcaaagcgttgcgtgagaagatg

SEQ ID NO: 356 - DNA, 405 bp, Pinus radiata
aaactccccaaggaagcaaggcaaaagttgttggattggtggaccagaaactataagtggccatatccttcggaaagtcaaaagatagcattggcagaatctaccgggctggatcagaagcaaataaataactggtttataaatcagcgcaagcgacattggaaaccatctgaagagatgcagttcgtggttatggatagtcctaatcctcacaacgctgcttttttcctggagggacatctcaggacagatggaactgccttttcaatggattgttgaagttaaacccatttttgaggcaaacaccagttttagtgcaatgctgtagatttgtctgactcatcttttatatgtatagctggatctctaaaatgggccatgtttcataacgtgctagatatgagt

SEQ ID NO: 357 - DNA, 468 bp, Pinus radiata
acttttcatgcgtttcgaaggccgccatgattctggcagagcacagcgaaggcgatgcagagctggaggaagtagcaggggaatgtttagagagggttccgcctttacacagccgattcacgcataccacaaaaagaaaaatgtacagttttctaatggacggcccatttgtttactgtgccatagtggatgaagcgctcgggaaaccgcaggtctttgtatttctcgagcatgtcagagatgagttcaagaaattgttgaagaacagaggttgtgaagggctcagttcgtgctgttttgataaagaattcggtcctgtttacaagcgccttgtggctcctcttgtgggtgttcctcaaatagaaaaggatcgcttgatggaggaagaatcgaaatcccaacctgctaaaacacatccagtccaggtaaataattctcccaaagattctctacctgtgtatgataata

SEQ ID NO: 358 - DNA, 499 bp, Pinus radiata
aagatgggagcttggtgatctgtgaaagatctctctctgcggctcaaggtatgcctatggtatcacagtctcaaagctttgtgcatggtgaactcttatctagtgggtatttgatccgaccctgtgaaggcagaggagcattagtcatcatggttgatcacaggaacttagaggcttcaagtgtccctgaagcacttcgtcccttatatgagtcatctacattctttgcacagaagatgacagttgaggcttcttatcatcttcaaggtaaagttcaaccggaaatgatttccttatcaaaaaaactccaacagccatgtaatgtacggtcatacagtcaacggctttgcagaggctttaatgaggcagtcaacacattacctgatgatggctggatgtcattgtccaaagatgggctgggggatgtcactatttgtgaaagctttgtcaaattgccggaaccaaatgcatcgcaaatagcctatgtcaacagcatggg

SEQ ID NO: 359 - DNA, 462 bp, Pinus radiata
acgggctctccaacaattaggcatgattcagcagcatgcttggaggccacagagaggacttcccgagcgatctgtttctgtcttacgggcttggctatttgaacattttcttcatccgtatccaaaagatgcagacaaacatatgctcgcgagacagactgggcttaccagaaatcaggtctcaaattggtttataaatgcacgtgtacgcctctggaagcctatggtggaagagatgtatgtggaggaaacaaaggaggcagaagtagaccatggatcaaatgataaaacaggtaaggagagtggcgagaaaaaagaagatgcattgtcaaaggaaggagctgcaggcaataatgggaatatacatgagcagcaaagtgggaaaatctcaaaactcgacaatattgcacaggatggaggtgctgatgaaaaacctgctggtgtgcccaaatctgaaaatgc

SEQ ID NO: 360 - DNA, 357 bp, Pinus radiata
ggagtgttgaaattcccctgttttgatctgataactatgaatctgatggagtcttttgaggcaaagggaaagggagagaagaggagaacggtgagggggaaaacccagttgaagagaattgagaacgggaccagcaggcaggttactttttgtaagcgcaggaatggtctgctgaagaaagcgtacgagctgtcagtgctttgtgatgccgaagtggcacttattgttttctccccaagagggaagctgtatgagttcgctaatcccagcatgcagaaaatgttggaacgatacgaaaaatgttcagaaggaagtaacccgacgagtacagcaaaagagcaagacgtccagtgttta

SEQ ID NO: 361 - DNA, 749 bp, Pinus radiata
gagcttcatccgccattattgggtttcaattcgatcttgatttgccagagacgatgtgaattaccattctgtgggcaaaagcgagagaggaggagaatggtgaggggaaagacccagatgaaaaggatcgagaacgacacgagcaggcaggttacgttttctaagcgcaggaatgggttactgaagaaagcttatgagctctctgtgctctgcgatgccgaagtgggacttataattttctcaccaagagggaaactatatgaattcgccagtcccagcatggaggagattttggaaaagtataaaaaacgttcgaaggaaaatggcatggctcagacaacgaaagagcaagatactcagtattccaaacattccaaacaaaagctcgcaaatatggaagaacagattaggattcttgaatcaacccaaagaaagatgttgggggaagggttggaatcgtgttcaatggcagaattaaataagttagagagccaagctgaacgaggattgagccatatacgggctcgaaagacggaaatattggttgaccaaatagaatgtcttaaaaggaaggaacgtctcttaagcgaggagaacgccttactcagtagaaagtgggttgatcgtcaatccgtggacggttccggttcaacatcatcttcaattggattgggaagcatcgagcagatcgaagttgagacacaactggttataagaccgccaaatgcacaggatcactgttctgtaaa

SEQ ID NO: 362 - DNA, 670 bp, Pinus radiata
gtttgcttgccgtgaaagaaatcgaacttccggcgcttgggtgcgagaaatatttgcaaatcgaacttccggcttgggtgcaagaagcttttgcgttttcggtttcagattaaagcaatatggagtcagaggaagacaaaatatctccagagaacaagaaaaggagattaaaaaccccacagcaggtcgaaggtctagagagcttttatgctgaacataagtatccttcggaagctatgaaatcacagttatcagaagaactgggattaacagagaagcaggtacaaggatggttctgtcacaggaggcttaaggataaaaggctcatgaaggaagaagcttccaacaatggaaaacaagatccacacaatggcataatgcaagattctgttaatggagtcaaacaagattctagcggcagtggaaaaaaatctgatcaccaacgccattcgaggtgcaaagaggttgaaagtcaacgatttgcgaatgccatggattatcctgcagctgtccttgcgtcagagcttagggatcatgatttgttcaaagtaaaccatgataacgaagacacctttgcaggaagtagttcagcttcacaagacagatcgtcattacaaagtgggaatccttatgaagctgaggcaagaagacgcccatttcagaatggtaa

SEQ ID NO: 363 - DNA, 651 bp, Pinus radiata
tagacctaattctgaggtcaatgaatctctgctgaaaacactttggcaccactctgatgccatcatgtgttgctccttgaaggtaaacatgtacaatatcatagactttcttctggagattaatttcaagtttgcacaattcttacgttaggctttgtttggtgctgtgcagtcattgcctgttttcacctttgcgaatcaggcaggccttgatatgttagaaacaaccctggttgccttgcaagatatatcattagaaaagatacttgacgacaatggccgcaaaagcttttgctcagatattgctcaaattatgcaacagggatacgcctatctacctgctggagtgtgtgtttccagcatgggcaggcctgcttcctatgacagggctattgcttggaaggtcctcaatgatgaggaaaatccccattgcatagcattcatgtttatgaattggtcctttgtttgaccattatttttcattgtacaaattataccgagtccttgaagttaacttattgaacaaaatctctttctggtcaagccttgtgtgactggccaaagaaaaaatacagagggagagcatgtaagcagcatatttggttgctacatttttgcttttaatttgaaaaatgaattctgttggacaag

SEQ ID NO: 364 - DNA, 257 bp, Pinus radiata
ccaaagaatttggcacgagcccgccagcaacaacaagttcacatacaattgcgataatcataccttcaactaccttgttgaagatggcttcgcatattgtgttgttgcagatgaatccgttggaaggcaagtaccaatggcatttctggagcgtgttaaggaggattttaagaggagatatggtggtggaagagctgacacagctgttgctaacagcttgaacagagattttgggtcaaaattgaaagagcacatgc

SEQ ID NO: 365 - DNA, 357 bp, Pinus radiata
gtgaattccaaccaaagtaatatgcttatacttcaggagagctgcacagatgcatctgggtcgttcgtaatttatgctccagtggatatagttgccatgaatgttgtgctcagtggaggtgatccagattatgtggctcttctgccatctgggtttgcaattttaccagatgggccaaagtgcatggcagtcaccaattcaggcattaacgacctaggcagtggaggatctttactcactgtggcttttcaaattttggttgactctgtgccaacggctaaattatccctggggtctgttgcaacagtgaatagtctcatttcatgcactgtggacaggattaaagctgctgttact

SEQ ID NO: 366 - DNA, 309 bp, Pinus radiata
attcactggtattttagcagcttttgtttcatctaaggtcacagagcatcagccccctggtcacatgccttcggtcacacagggctccgccatggccaaccccaatttcgtggctttgcataataatcagggtcatgacggaggagcaaatggagaccctgcgcaggcaaatttgcgtttattcaacaattggcagtcagttggtagaaatgcacagagccatgtcacagcagcaggccttcttcagtggccgactctgcttatgggacaacacatgctttatgatctagctcaaggaaatccagggtt

SEQ ID NO: 367 - DNA, 575 bp, Pinus radiata
ggaaggaaagaatggggcgagggcgcgtcgagctgaagcggatcgagaataagattaaccgtcaggtcacgttttcgaaacgccggaatggtctgctgaaaaaggcgtatgaactttcagtgttatgtgatgcagaggtagcactgataatattctcaagcagaggaaaactctatgagttcggaagcgccgggtatggtattgaaatctctggacttttttctgggattttgtattataatattagagttggagaaggctgtgagggagagaagagaggttgtaaagtttattccgtgatttgttttaaaggaaaatcttaaattagctaaaacttttgtgcacgttcaaaaggcctttaaattttctctccagttgagagtattttgagaaaataagccgaatgcgcccgggagccacacaattgtagcaagcttcagtttattttcaaagcatttctccgaataagctagaaatgctaagaattttgtgaatcgctaaagcatttgtaacatatagcgcagatatcaaaaaaataaagaatttatcggtaaaaaaaaaaaaaaaaaaaaaaa

SEQ ID NO: 368 - DNA, 243 bp, Pinus radiata
ctgagagttaagtgattgttgggagggaaaagagaaaaaagaggagatcaagaatggtgaggggaaaaatccagatgaagaggattgagaatacggccagcaggcaggttacattttccaagcgtagaaatggattgctgaagaaagcttacgagctctcggttctctgcgatgcagaagttggacttatgattttctcgccaggaggaaagctctatgaattcgccaataccagcatggaga

SEQ ID NO: 369 - DNA, 184 bp, Pinus radiata
ctatgctattacagaatgtgcctccagcactacttgtccgcttcttgcgggaacatcgctcagagtgggctgattgtaacattgatgcttattcttcagctaccatgaaagcaaatgcttacaatgttccaggttcactgggaggcattacagggagtcaagttatccttccactggcacatac

SEQ ID NO: 370 - DNA, 158 bp, Pinus radiata
acatcccgtcttcactttgttgatcaacaattacgacaacagcgagctcttcagcagctaggaatgatacagcagcatgcctggagaccacaaagagggcttccagagagggccgtttctattctccgggcttggctatttgagcatttccttcatcc

SEQ ID NO: 371 - DNA, 462 bp, Pinus radiata
gcagtggtcatatggatgggggatccggagaggaccaagatgccgccgatcaagatcacgatcacgatcacgatcatgatcacgagcagcagcagacgcggaggaaacgttaccacagacacactgctcgtcaaattcaggagatggaagcgttgtttaaggagtgtccacatcctgatgacaaacaaaggcagcggctcagcattgaattgggcccttaagccgcggcaggtgaaattctggtttcaaaatcggcgtactcagatgaaggctcaacaggatcgctcagacaacgccattctccgtgcagagaatgaaaatctgcggaacgagaacgtagcactccgagaagcaattaaaaatggtgcttgtccaaactgcggagggtctacatcgctgggagagatgcctggattcgacgaacaccatttccgtatagagaatacgcgcttaaaggaggag

SEQ ID NO: 372 - DNA, 510 bp, Pinus radiata
gcaaccggagctttaagactagaatatatatgtagccctcgggctctgacgaatactgaaactagagatacccacctcttatctggtgtgtaaggcacgcaaaatgggaaagaagaaggtggaggtgaaactcattcaaaaccctaccagtcgccaaggatgtttctacaaccgcaagtgcggtttgcttaaaaaagcgtttgagctttctgttctctgtgatgctgaagttgcccttataatcttctcccaaaccggcaagatttacgagtttgcaagccatgacgacgtcaacgcaattctcgcaaaataccggatacaaacgggaacaacaacaaacgcgatgccttcctcgcttcaaaacaccgagccggagacgttgcatgaggagacaaatatgttgggaaaaaggaaaaaagtggagaagttgcatgagaagatcaatatgttggaaaaaagaggaaaaaacatggtttggtgaaaatttggagtcattaacggtcaatgaat

SEQ ID NO: 373 - DNA, 466 bp, Pinus radiata
tggatcaccatgcagtagaggatagggagttaaaaaatcatctccttcgcaaatacagtggatatttgagtagtctaaaacaggaattcatgaagaagaaaaagaaaggaaagctccctaaagatgcacggcaaaagttacttgattggtggagtctgcacgacaagtggccttatccttcggaaacggagaaaatagctttggctgaatgcacggggttggatcaaaaacaaataaataattggtttataaaccaaagaaaacgccactggaagccttctgaagatatgcacttcatggtaatgaacagtcacagtcctcacagtgctgccttgtatgttgagagacatatgatgactgaagggtatctttagattgctagaaagaaccttcggctgaaaacagcacacaatgctattgcttttgttgtatttaattggcatggctttcaattttaaaaaaaaaa

SEQ ID NO: 374 - DNA, 573 bp, Pinus radiata
atctctgttgggatctagaattgagaaagggacgcttgtgggctggtgggtttccacaatgagaggctcctcccgtgcatatgatgcattttattctatttgttgatcctgtcaatggaaaaaaagagagcagtcgaatttggcattgaaatacatgatcagcaagagattgaaacgtagcttatggacccccgaaggaatggtgggggggaatacgaggtaggaggtagccagccgaaagagctgatctcagagaactattatacaaacacagtctgcaaaagaagaaatactgtgatgcatttttggatgatgcagtaaaggcagacacctatgaaaaaattgtttcattctgagatatggaacacctgaatgcagctgctgcccaggcctcctcttcgctttatggagttagcatggccgagtacggagacgtcggcgtcagctcaatgatggcgctgatgacccaacacgagcctcatgaaagcgagagcacaatgacgacgagtatgcctagttcattttcatcgttccatggccatgctgaatgccttctctcagcagcaatgttcc

SEQ ID NO: 375 - DNA, 526 bp, Pinus radiata
ggattcttgtatttttgtgtgttgctgctgcaacagttcttaaataccaagacattgatgagagcttgagtaatatttctgcaaaaacccaagtaaaccctgaagctagtccaaactagtggaaggaacctcggctattctgtaagttcactcagattttgagaaactcttgggattttgctcaaaatggggcgtggtaaaatagagatcaagaagatcgagaacagcgtgcacaggcaggtgaccttctgcaagcgccgaggcggtctgatgaagaaagcctacgagctttcagtgctgtgcgatgcagatgtagcgctcattgttttctcgagccgaggaaagttgtacgagctgggcaccagcaacaacaacaacaacagtatgaggtcaatattggaaagatatcaaaagtgttcacagacggcaaaacatatgaacttttcgaataatacttcagacgagaaaatgaagcaagaaataaatttacttaaacacaaattgatcagctaaacttactaacaga

SEQ ID NO: 376 - DNA, 335 bp, Pinus radiata
aaaatggcggcttagatgaattacgagcagagactcatcgcagcggcacggctagctgacaacctgaactccacgactgcaaaagaatttgatattcccagcgctgaagaagttgccgagaaatgttcagaatggggagtcaccgcacagctgaaggcacaccaggcccaaggactgtcatggctgatacgccgatatgccattggcgtcaatgttatacttggggacgagatgggacttgggaaaacattgcaggctataagtttgttggcttacttgaaagatcgacggaaatgcccagggccatttttggtattgtgtccattaagcgtaat

SEQ ID NO: 377 - DNA, 773 bp, Pinus radiata
gaagtgtggatgttcttactgctttctcaactggaaatggaggaacaattgagcttttatacatgcagatgtatgcgccaactactttagcttctgcccgagatttctggactcttagatacacttctgtattggaagatggtagtcttgtggtttgcgagagatccttgagtggaactcagggaggtcccagcatgcccgcggtgcagcagtttgttagagcagaaatgcaacccagtggatatttgattcggccatgcgaaggtggaggttctctaattcatattgttgaccatatggatttggagccatggagtgttcctgaagtgctacgtccactgtatgaatcatccactgtacttgcccaaaaggttacaatgtcggccttacgccatttgcgtcaaatagcacaagaggcatcttctgatgtggtccttggctggggaagacaacccgctgcattacggacatttagccagagattgtgcaagggtttcaatgaggcagttaatggcttcacagatgatggatggtctttgatgggtaacgacggaatggaggatgtaactattctcgtcaattcatctccaagcaaactgttcggtcaacagtttgcttcttccgatgggcttcctgctcttggtgggggcatcctatgtgccaaggcttctatgctattacagaatgttcctccagcattgcttgttcgtttcttgcgagaacatcgatcagaatgggcagatagtaatattgatgcctattcagcagcctct

SEQ ID NO: 378 - DNA, 407 bp, Pinus radiata
atggcaatggaagagaggagtggtgatcttttgaaaggctgtggtctttctgagaatgcattggatgctatctctgagggttctatacagaatcattggtcatggtcagaagtcaagcaattgtctgtaactcttcttcgtgctctagatgcgggaattgaacactctctccttggttctatgatgtcaatagacagatatgcagcagcagagagctttcatagacttgcttgggcttatgcacacgtgccagatctgcatatcatgtggcttcttcatttatgtgatgctcatcaagagatgcagtcttgggcagaagctgcgcaatgcgcagtggctgttgctggggtcataatgcaggcattggtaggaagaaatgatgctgtctggggaaaggagcatgtaac

SEQ ID NO: 379 - DNA, 385 bp, Pinus radiata
cgaggtcgagtccagctgaggaggatcgaaaacaaaatcagtcgtcaagtaactttttctaagagacggaacggactgatgaaaaaggcggcggagctgtcaatactgtgcgacgctgaagtggccttaatcgtcttctccaacaaagacaaactgtacgagttcgccagttccagtatgaccaagattttggaaagatatcggaagcgttcaaatttaatacaagatatcggtaaagatccacagaattcagacattgagttgacgcgtctaaaagaagaggttgaccgcttacaaagatccagaaggcatcttttgggtgaagaccttcatcaactaggtgctacggatctgcaacacttagaacaacagcttgaagaagcgt

SEQ ID NO: 380 - DNA, 513 bp, Pinus radiata
tttcaatgcccctctttttccagtggacgagtgttcaattttccctgtgttgatctgatacctataaatctgatggattcttttgaggcaaagggaaagggagagaagaggagaacggtgaggggaaaaacccagatgaagaggattgagaacgcgaccagcaggcaggttactttttctaaacgtaggaacggtctcctgaagaaagcttacgagctctcggtgctttgtgatgccgaagtggcacttatggttttctccccaagagggaagctctatgagttcgccaatcccagcatgcagaaaatgttggaacgatacgagaagtgttcggaaggaagtaaaacaacaagtatagcaaaagaggaagatcccaaggctttaaaacgagaaattgcgaatatggaagaaaggattgagattcttgaacgcacgcaaagaaagatgttgggcgaggaactggcatcatgtgcattgaaggatttaaatcagttggagagccaggttgaacga

SEQ ID NO: 381 - DNA, 210 bp, Pinus radiata
cacagttctggaacctgttaaagagaaatcagtcgaggtcaaactccttctgtttgcacgaggatgcccagcattatggagaagcaaaatagtggtgaagatagtgatagcaagggtcagcttgataatggcaagtatgtccgttacaccaatgagcaggtggagactttagaacgtgcttataatgaatgctcaaagcccagcacaagc

SEQ ID NO: 382 - DNA, 380 bp, Pinus radiata
cttcgttctccaggatttctcgacaggttttaaacgacgctagcaaccccctgtgattttacagtctgttttgccaggccggtgaaaatgggtgcattcgcccttctatcaagctggattgatgctgccactaatcccaagtacaggaagaagcgtaaacaatttcagaccgtggagttgagagttcgaatggactgtgaaggctgtgagagaaaagtgagaaacgcactaaattcaatgaaaggagtaagttctgtagaagtggagagaaaacagtataaggcaacggtgacgggatacgtggatgccaacaaagtgctgaagagagtgaggcaaacagggaaaaaggcagaattgtggccttacaagccttaccatct

SEQ ID NO: 383 - DNA, 407 bp, Pinus radiata
ttttcaaacacttggttttcaggcaatttacttgcccctggagccaacaaacagatgcatcttgattccagttctactggagcaccagggctctcaaatgttctgataggctccaagtatcttaaagcagcacagcaattgctcgacgaagttgtcaatgtaggtaagggcatcaagcctgattcagccaaacatcagaaatcacaatcatggattggaacaacagctaataaagagaatagtggagctgaaggtggtgggaaggatggagcagctgctgcccctacatggcgttcaacttcagcccaagaaacaaatgaccgtccctctgagctgtcaccagcagaaagacaagagcttcagatgaaaaaagcaaagcttgtggccatgttggatgaggttgatca

SEQ ID NO: 384 - DNA, 441 bp, Pinus radiata
ggcaagaatagttgcctgatagcacggaatttattaagtggccttagaacgtgttcagagatcgctgaatacatgtcccacaatgtatctgcaatacagcatggagttggggatgtatcaacactccactctgatggtagcaggaagactgattgtggtgatattctgaagttcggacaagagcaagattttggcgtagaaaagggagagtgcggaggtttaagtacacatgcaagtctgctggtcatccatcaatcaggaaaagaattaaagatggaaaaggacagccatgtagacaatatacaccatgtggttgtcaactgacatgtggaaagcaatgcccttgcctccgaaatgggacttgctgtgaaaaatattgtgggtgctcaaagagttgcaagaaccgtttcagaggttgtcattgtgctaagagtcaatgcc

SEQ ID NO: 385 - DNA, 423 bp, Pinus radiata
agcagatgaaagcctttggattccgaacctggatgctggtaaagaaactcttagctatgaagaatacatgcgccaattcccttccacaattacgccaaagcctataggccttgccactgaggcgactagagaaactggcatggtgatcacaaacagcttgaatcttgttgaaacactcatggatgtggatcactggaaggaaatgttcccctgcatgatatccagggcagccacagtcgatgtaatatcgagcggaatgggcgggacaaggaacggtgcactgcaactgatgtatgcagaattgcaagtgctttcaccgttggttcctgctcgagagtacttctagagcggccgcgggcccatcgattttccacccgggtggggtaccaggtaagtgtacccaattcgccctatagtgagtcg

SEQ ID NO: 386 - DNA, 445 bp, Pinus radiata
gcaaagcgaaaatattatgtccacgaggatcccaagctcgttttcatcattccatggccatgccgattgccttctctcagcagcaatgtttcagggttctcaaggagatcataagctcaatccacagcctgggatgaaccagcagctagtctctgagcagtctatcatgtcagattcgtccatgccgtttgttaagacaaaagcttgctctggtcttcgtaatcagtttgaatttcacagggaacaacccggaaattgctacacagatcagtcctcaaatattccgctaagccccatagtcacatcgttagcctcgcaggctcgaggagaagcgcggatgataccgtccttggatgccaacagtgctcatttcaatgtggataacgaggagcatgcaataaaatcgaaaatcttagcgcacccacagtatccgagcttgttggga

SEQ ID NO: 387 - DNA, 343 bp, Pinus radiata
gaactagtcaatcagagatgccatgagaaatcccatctgcacaaactgtggaggacctgctgttcttggcgagatgtcctttgaagagcagcaacttcgcattgagaatgcccgcttaaaagaagagctggatcgattgtgtgcactagcagggaagttctttggcagacccattccttcaatgccatctgttccccttatgcctaaatcatccctagaccttggagtcggtggcatgcccacttcgttgccctcggctagtgcagacttgatgcatggacctgctggtggtcgaacaggaaacataataggtattgagaggtcgatgctggctgagcttgct

SEQ ID NO: 388 - DNA, 1193 bp, Pinus radiata
ccgttgttgttcctttctccaccctcagcgtctccttacacacacaattcaatcaatcccctcgccacgccaccgcgttcgcctgttcttcctcctctggatcaacccattcccacagtcctacttcgctcaatccgacggctaatttttgcgaaatctctgtctctttctcttattaccggtttctgattagaaactggcaaaaacagaggatttagcagtacccaactggggaacagagcgttccgaatgatgggtattgttgtttcctgctgtctggtatctcgcatgcgagctctctggagaagcagcttctttcgccataaagttcacatatctctgggcaactactggttttgctagcgattctgaggtgggcatatgctcagcttttaatgctactagaggacaccgtttgaaggagtttttctctgaggagatgatgatgtctggtgggagaatgtatggtgggccgaacgtccttgtcacggccaacgagaacatttcccgctctgcagatgcactggaagctctactttcttctcctgttttcaatggttcaagatctgtagctaatttggaggaggtgataggtaatgtgtcaaaaagatcattttacaattcctttgaccaggaagaaactggagatgaagaccttgatgattgtatccatccaccggagaagaagagaaggctgactgctgaccaagtgcagttcctggaacgaagctttgagatcgaaaacaagttggaacctgagcgcaagatacagctagccaaggagttgggcctccaacctaggcaagttgcagtctggtttcaaaaccggcgggcaaggtggaaaacaaagcagttggaaagggattatgatattctgaaatcacgctatgagaatttgagagttgattatgatagcctgctcaaagaaaaggataaattaagggctgaggttaccttcctaacagacaagctacacgacagtgaccatgaagccctcacaaaggattctgagtctgctgacaagaaagtctatccccagcctgcctcccactctgactgtgttggggagcctgaaagaagtactgctgccaaggatacaccaccaggttgtaaacacgaagatcttctgagctctggaacagatagcagtggggtcctggatgaagatagtcctcaccatgttgactgtggtc

SEQ ID NO: 389 - DNA, 385 bp, Pinus radiata
aaaattgagaatactacaagccggcaggttacattctgtaagcggaagaatgggttgctgaaaaaagcttatgagttatctctgctgtgcgatgcagaagtggctctcctcattttctccaccagtgggagactctatgaatttgcgaataagagtgttagcgcgacaacggagcggtacatgagaacctatgcagagaacatgcctcagtctcgagctctgtatccggattgtcaccattggcaagaggaagtcagaaaacttacacagcaacgtgatagtctaaccaattcgatcagacaaataatgggtgaaggccttgaatcattaagcatgaaggagctcaagcatattcaagttcaattggaaaaaagtattagttgtg

SEQ ID NO: 390 - DNA, 359 bp, Pinus radiata
gtacactgcagagcaggtggaagctctggaacgcctttacaatgactgcccaaagcccagctctctgcgtcgccagcagctcatcagagaatgcccaatcctttcacacatcgagccgaagcaaatcaaagtctggttccagaatcgaagatgtagagagaaacagcgcaaggaggcaagtcgtctccagactgtcaacagaaagctcacagccatgaataagcttcttatggaggagaacgatcgccttcagaagcaagtctcgcagttggtttacgagaatggctatttcagacagcagatacagactgtttctattaccaccacagatactagctgtgagtctgttgttactagcg

SEQ ID NO: 391 - DNA, 257 bp, Pinus radiata
caagcatgaatttgatgtgcggtatcagaagcttgaggacaaactatatattgcacagctttatttccccctgattggactgatattggatgagatgccggttttttacaacctcagcacagtggagaagcgtgaagttctaatctgtatcatgcagataatccgcaatttggatgacccatctcttattaaggcatggcaacaaagtattgctagaacaaggctctttttcaagcttctggaagaatgtcttgtcc

SEQ ID NO: 392 - DNA, 290 bp, Pinus radiata
ggcctcctcgtgactatgagactcttcgcagcgactgaaccgaaacgtgtcttcgcagtgacaaaacgtatttttcttcttggtttcgtgtctttctttctgcgtgagggcctcgtagccagcgtgtggcttcctgtttctccgcaaagattatttgatttcttgagggatgagagactcagaagcaagtgggatatactatcaaatggaggtccaatgcaagaaatggctcacattccgaaaggacaagatcctcgcaactgtgtttctcttctaagagcaagcatatg

SEQ ID NO: 393 - DNA, 465 bp, Pinus radiata
gctggtatcattatacaacaatcatttgaatggaatattggcagatgaaatgggtcttggcaaaacagtgcaggtaatttcattaatatgttacttgatggaacaaaagaatgacagaggacctttcttggtagtagtgccttcctctgtattgtctggttggctgagtgaaattagcttttgggcccctagcatcagtaaaattgcatatacaggttctcctgatgatcgccgtcgattattcagggagaacatttctcagcaaaaatttaacgtgctcttaactacatatgaatacttgatgaacaaacgatcgaccaagactgagtaaaatttcatggcattatatcataattgatgagggacatcgcataaaaaatgcatcttgcaaactgaatgctgagctgaagcactatcatagtagtcatcgattattgctcacgggaacaccactccagaataatc

SEQ ID NO: 394 - DNA, 157 bp, Pinus radiata
tcccaaagatgctgacaaacatatgctagcaaggcaggcaggtttgacaagaagccaggtctcaaattggttcataaatgcacgtgtccgtctctggaagcccatggtagaagaaatatatatggaagaaatcaaggaagctgagttaggacattca

SEQ ID NO: 395 - DNA, 384 bp, Pinus radiata
accaatttaacggcgaagcaaccgacccccctgaaatccccttaacacgaatttctgagctggggccggtattgtgtagcagcaggatgatgacgccaaggtttatgaatccccccttcgacggaagaacgcagaggcaccgcggacccgatggagatttctacccctggaatcggcccttgaaaatccttaccagggtctcatgaagcactgcacatccctgctaaaaacgctaatgaatcacaaatttggttatgtttttaacgagcccgtcgatcctgtggccctgggggttcccgactatttcactgttattacctcgcccatggatttgggcaccatcaaggcaaaattgcaggacagcgtttattcaagccctctcga

SEQ ID NO: 396 - DNA, 694 bp, Pinus radiata
gttgcactggagttgctgcacgagcttgtggctttgcaggtctcgaaccttcaaaggtcgcagatattcttaaagatcgtcccgcttggcttcatgattgtcggcgcctggatgttttgactgcatttcctacgggaaaaggaggggcagtcgagcttctatacacgcaaatgtacgctccaactacattagcccctgctcgggacttattgactctgagatacacatcattgttggaagatggcagccttgtggtttgtgaaaggtcattgactggtactcagagtggtccaaacatgccgcctgtccagcactttgtaagagcacagatgcttcccagtggttatttgatacgtccctgtgaaggtggaggctgtataattcatattgttgatcatatggacttggagccttggagtgttcctgaagttatacgcccactttatgaatcatctgctgtactggcccaaaaaatgaccattacggcattgagacatttgcgtcaagtagctcaagaggtctcaggtgaagtggttcttggttggggtaggcagccagctgctctgcgggcatttagccagagactgtgcaggggtttcaatgatgctgtgaatggctttgcagatgatggttggtctttgttgggtagtgatggggtggaggacgtgatcattgccataaattcatctccaag

SEQ ID NO: 397 - DNA, 493 bp, Pinus radiata
ccaatatttacgtcagcaattacaattgctgcatgcacgtgctggcaataacaccagatctcttcagcagatggcagtgactgcaaatgacaccagctctgattcagttgtaacaagcgggcaacggcagcaacactcaccgcaacatcctccatacagtgtaagtacctccaggttgtttttcatagcagaggagacattgacagagtttctagcaaaagctacaggaactgctgtggactggatccagatgcctgggatgaagcctggtccggattccattggtgtggtggctgttgcacatgcttgtggtggagtggctgtgcaagcatggggtgttgttagtttggaaccttcagaggtagctgaagccttgcgagataaggtatcttggctttgtgactgccggaagatggaggttctggggacttttgattcaactgatggacggaaattggaactattacatacacagatgtatgctccaataact

SEQ ID NO: 398 - DNA, 436 bp, Pinus radiata
atggggaagacgaagatggagatgaaacacattcaaaaccctagccgccgccaagttactttctcgaaacgcaagaacggattgctaaaaaaggcattcgagctttctgttctctgcgatgctgaagtcgcccttatcattttctcggaaactggcaagatcagcgagtttgcaagccacaacgacatggcaacaatactggaaaaatatcgcatatacacgcaaacagaaacagatggaaacatgggggcttcgtcggtccaaagcgtgaagggatggtttcctaattttctcgagattgcgggattcagtgtttgtggatgatccctattattgcagtgtgggttggggcacgaggggtgcagttgactcgactcatatgattggaaggttggtgaatcacaattgaaagcgttgcacgagaggatggacaatt

SEQ ID NO: 399 - DNA, 419 bp, Pinus radiata
ctcagagctcgacaaaacctacatacattcgtctgtcatccctcccagaaatacctagtgagggcgatcgaggtcgaaaggggcattttacgccattgaagcggtgtgcatagggtcaactctgagaactgattgtgtcttccttcggagggagagggttagcgaggttcagaaagagagagaaagagaaagtagtcctaagggactgtttaaaatggggcgaggtccagtccagctgagaaggatagaaaacaaaataaatcgtcaagtaacgttttcgaagagacggaatgggctgataaagaaggcgtcagagctgtcaatcctgtgtgatgcggaagtggccttaattgtcttctccaacaaaggcaaactctatgagttctccagttccagtatgaccaagattttggaaagat

SEQ ID NO: 400 - DNA, 690 bp, Pinus radiata
cttagcctttccccccaacagctttcaaatatccaattatcctgctttcaaaatcagcctacagactcagaagtgaattgccccagtatttcagaagcaacttcacaggagaacttgaataggtctgatagactaacaagtaaattgtcaggaagtctgagttcttttcgggcttcctcaagggatgggatgctaggaactaaatttctaggtagtgtgaatggccctgagtgtaacaaaccgatgcatcatggtacgaatgcaattggagcagcagagctctcaaacactttaactggttccaaatattttaaagcagcacagcaattacttgatgaagttgtaaatgttggaaagggtatcaagtctgattcagtcaaccatcaaaaatcccaaacatggtttggtgcaatatctgacaaaaagaatattgcaactgaagctactacaaatgaccgaacaacatctgcaataacaggagcttcaatttctgcagaagtaatgaaaaacgagcatgcttttggactcacaccagctgatagacaagaacttcagatgaaaaaggcaaagcttgttgccatgttggatgaggtggatcgaaggtacagacagtactatcatcagatgcaaatcgttgtttcatcgtttgagaccgcagctggatttggggctgccaagacatacacttct

SEQ ID NO: 401 - DNA, 383 bp, Pinus radiata
ttctcgcccgttttttccctgcactcaccacttccatcgccattgctggaaccctagaagaccagtctctttcttttttaactcaggagttaaatcgcaatacaaaactcctgtgctggactctattgtatcatagtattcagcaagagaggccatggggcggggaaagatcgagctgaagaagatcgaaagcacaagcaacaggcaggtgacgttctcgaagcggcggatggggttgcttaaaaaggcacaggagctttccgtcttatgcgatgcagaggtcggcgtcatcattttctctaataccggcagactctacgacttctcgagctccagtatggagaagatgattgaaacatactatcgatttattgaaaaaaatg

SEQ ID NO: 402 - DNA, 846 bp, Pinus radiata
atcaaatctaactggatatccaagtgtaccgttatttggttacttttgttcgcaggatgcttctatccccattttgtgggaggaaattactcagcccatactagagttgaatcctttggggatagacttcctaccattggatttgtgtctgttgcaggctgcataatgtgtttccattttgcgcattgtttctttgaatcttaattgctagttttcctacttttgtatggccttttaggtaacattgttcttagttttacaggtccttgatcggggtgaaaagatagaacttttggttgacaaaacagagaaccttcgatttcaggctcaagacttccagaagcagggaacacaacttcgccgaaaaatgtggtttcagaacatgaaagtcaaactggttgttcttggaattgtctttgtgttgattcttataatctggctctcaatttgccatggatttaagtgccattaatcttgattacttggcagtcctttctagatacaatcctttcgaggcatttatattcattttttggcagcttggcttataatagatgcaggctctctttgaaaagagtatcttttgtgttgtgtctgagtaatgtatttcattcacttggatactctcatcattagatactgattatctatgtttttctctgacgagggacaatgcctcgactcttcatagtttaggttattggcactacccatcagctgtgatgtcaatctcttttataaatatgaatccctgcttttggttttcaattttaacgttcacatagcctgtattatcagcagtgcttaattaacgcgggaaacctttggataaaaaaaaaaaaaaaa

SEQ ID NO: 403 - DNA, 333 bp, Pinus radiata
gccaaattcgcgctctgatggaaatgggaaggctgaccgtagtgattctatgggaacagaagctcgaacacgaacaagattttggcgtagaaggggaagagtacggaggctgaagtacacttggaagtctgctggtcatccctcaataaaaaagcgaattgctgatagcaaagatcagccatgtaggcagtttacaccatgtgattgtcaatccatgtgtggaaagcaatgtccctgcctacgtagtgggacttgttgtgaaaaatactgtgggtgttcgaaaggctgcaagaatcgtttccgaggatgtcactgtgcaaagagtcaatgtcg

SEQ ID NO: 404 - DNA, 881 bp, Pinus radiata
cgcctctcagttctctggtaacgatatgcgtaattatggtgctaaagaagttacttcagggttggctaccggcggtcaacggccgccagctctgcagctaaacctcgcagcccttgatagcagcggagatggcgcagccgctaaagaaaaacgaacgccgaaggttaatccgtattatcttaattcagagtttgtaatggggaaggataagatgccgccgccgccaccggataataagaaagggggaatgaagagaactgctcagggcaagtcagaaattagggaaacaaagagacctgttgctgatcccatgaacggcaagatactgcaagatgtcatgaaacagtgcggatttctgctatccaggctcatcaaacacaagcatggctgggtttttaaagcccccgtggacactgtagcgctcgggctgcatgattataacaccattataaagcagccaatggatcttggtactgcaaaggcgaagctaaatgcaaacgagtataaatcgccacaggaatttgcaggggatatcagattgacgtttaacaatgctatgacctataacccaaatggacatgaagttcatatcatggctgagcagatgttgcagttttttgaggaccggtggaaaccgatttgtgataggtatgaagaggagaagaggaaattgtcatggtcagtaaatgatgggctattacctggggcaagccaaaatatgaagaattttccttttggtgaaaccccaaagaagaatttgaagaagacggagcctcttctgggtttgtcgccacggcctccacctaatgcaaagtccaaggctaatcagactttgcgagcccctgctcccaaaaaacccaaggcaaaagaccttcataagc

SEQ ID NO: 405 - DNA, 434 bp, Pinus radiata
gaaatttgatatatgtgttactagttttgaaatggcaattaaagaaaagactgcacttaaacgtttcagttggcgatacattattattgatgaagcacatcgaataaagaatgaaaattcacttcttgcaaagacaatgagaatctacagcaccaactacaggcttcttataactggcacacctcttcaaaacaaccttcacgaactctggtctcttctcaatttcttacttccagaaatttttagttctgctgaaacttttgatgactggttccaaatatcagctgacaatgaccaacaagaagtggttcaacaacttcataaggttcttcggccatttcttctacggagactgaagtcagatgttgaaaagggtttgcctcctaaaaaggaaaccatattgaaagttggaatgtcacaaatgcaaaagcaat

SEQ ID NO: 406 - DNA, 450 bp, Pinus radiata
aagctcggtaattctgttcatagagcaaatttaagttcaacgcctgcccatactcagattttgggattttgctgaaaatggggcgcggtaaaatagaaaccaagaagatcgagaatagcgtgcgcaggcaggtgaccttctggaagcgccgaggcggtctgatgaagaaagccttcgagctttcagtgctgtgcgatgcagaggtggcgctcatcgttttttctggccgaggaaagctctacgaacttgaaaccagccacagcaacaggaacaagtatgcctgaccatattcaacttctactacacatcaatgccggtggttttaatctacatttattgatcatgaatgtttgcttttgcttcttctaatgttctaggcgggctacatttaatttagagggttcattctggaatctgactagccatcagtttctattctgtgataaggga

SEQ ID NO: 407 - DNA, 376 bp, Pinus radiata
cttggtctcaacttacagactgctgatactgtgatattatttgatagtgattgatgctaaggttatccaggctggtcttttcaacaacacttccacggctcaagatagacgagagatgctggaggagatcatgcggaggggaactaactctttaggaacagatgtgcctagtgaaagagaaataaatcgccttgctgctcgtagtgacgaagaattttggctctttgagaaaatggatgaggaaaggaggcaaaaggaggggtatcggtcaaggttaatggaggagcatgaagttccagactgggtcttttcagtccctacaggaaagaatgacaaaggtgttgaaaatatggattccaatcttggttttgaccag

SEQ ID NO: 408 - DNA, 551 bp, Pinus radiata
aggcggatagtccccatttcaatgaggcggatgcaataaaatccaaaatattagcccatccacagtatccgaacttgttgggagcttacatcgactgtcaaaagattggggctcctcccgaagttgcggcgcgtctagatgcgcttagccatgaatacgaaaaccaacaacatcggtcgagtctgagcatcggaatggacccagaactagatcaatttatggaggcttactgcgaaatgttaactaaataccacgaggagctcacaaagcctttcaaagaagcgatgtcatttttgaagaagattgaagcccagctcaattccctaggcaaaggaacaatacgaatttctccttcagccgagaatgatgaaaagaccgagggaggtgcatcttcagaggaggtcgaggatggcagtggtggtgaaacggactttcaggaagtggatcaccatgctgtagaagatcgggaattaaaagatcatctccttcgtaaatatagtggatatctgagtagtctaaagcaggaattcatgaagaaaaaaaaaaaaaaa

SEQ ID NO: 409 - DNA, 366 bp, Pinus radiata
tgtaagaatgtttttactagattgcaaggaccagtcaaggaaggacgacacacagcactgtttatggagattccaaagagaaatgagaatcccacttactataggcttatagagaaccctattgatgctcgaacaatagaacaacgtcttgaccgcttttcatatgggagtgttcttgactttgctgcagatgtgcagttgatgctggagaatgctatacgtttttatggtcactcttctgaggtcaaggcaaatgcaaggaggcttcaagctctcttcttccagcgtatggctgattccttcccagatgataattttagctcttttaaaactcgaagcttggttgctcttggtcaaagtgcaaat

SEQ ID NO: 410 - DNA, 346 bp, Pinus radiata
ctggtaaattctggtatggcttttggtgcaaaacgatggatagcaactttgcagaggcaatgtgagcgtctcgcaagtgtcttggctagcaatatcccatcaagggaccttggggttatacctagccctgaagggagaaagagcatacttaagttagctgagcgcatggtcacaagcttctgcgctggtgtaagtgcatcaactgcacatacttggacaactctgtctggaagcggtgctgaagacgttcgtgtgatgaccagaaagagtgtagatgatccaggcaggcctcccggcattattcttagtgctgcaacatccctctggctgcctgtgccccccaaaa

SEQ ID NO: 411 - DNA, 393 bp, Pinus radiata
ttttggagtcacagttcgatcaatcatttgaatatccaccggtggagcagttggttaagcagtgtggtaaatttggtttgctagagaggctattaaaacatttgaaagctcaaaaacacaagatgttgatattttctcaatggactaaagttcttgacttgctggaatactatctaagtgagagaggatatgaggtttgtcgcattgatggaagtgttaagttggaagataggaaaaatcagataagggatttcaatgacccagatagcaacttttgtatctttttgctaagcacacgggctggtggtcttggaatcaatcttactgatgcagacacttgttttatctatgatagtgattggaatcctcaaatggatatgcaagctatggatc

SEQ ID NO: 412 - DNA, 830 bp, Pinus radiata
gttaagcttggaacgactaacacttggctcagcagagccgtctcgggacagcacagggcgcagcagcagcagcagcagcactacgcggaacggagcgtggaagagggcaggaaatggtgcggctgcgcggccggctctcgcgactgtattcattctaatttcttgaagctccagaacccggcaagtgcgggttcgagctccgctgccgccaacgcgctgtccggcagatggctaatgcccggacctttgctgaacgacaagattgaggggagggaaggggtcgagctacttggaggagaaattccgggcgagtctattatggcattatccgcacaatttaagactgcgggttctgctgcgccagaaagggggctgttgaatcttcattcggcggatgctgtgaatagcaacggagaacctgtagatagcggaggggccggtggagatagagacggaggggaggaggcggaggatcatgcagcgttgtggcaaagcgccaggataaaagctgacattgtctcacatccgctttacgaccagttactgtccgcacacttggagtgtcttcgcatagcgactccgaaggatcagcactcgatgattgacgcgcaattagagcagtcgcagcatgtcgtcaccaaatattccgtccttggcaacgataatttcctcgtcggcgacaagaaagaactcgatcagttcatgacacaatatgttttgctgctttgttctttcaaggagcagctgcaatatcacgttcatgttcatgttatggaagccgtgagggcatgcattgaccttcagcattctcttctaacactaacaggagt

SEQ ID NO: 413 - DNA, 371 bp, Pinus radiata
aagctgtgcagtacagtctcagccagcagcctctgggactcgatggaatccaacaccagaccagattagaatcctagaaatgttttacaagggaggaatgcgcacccccaatgcagaacaaatcgagcacattacagcacagctgaggcagtatgggaagattgaaggcaagaatgtgttctactggtttcagaaccacaaagccagagaaaggcagaagcaaaagcgtaacagcagcatgcaccaggtagctgctactgcagcaaagaaaactccaacaacaataatggcagataaccctaatgaacttcacaagcccaactccaacggcacatactctctctataatttgcctttcacagcaatgtctg

SEQ ID NO: 414 - DNA, 395 bp, Pinus radiata
gagcactcaaaatggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacagatggaaacatggagtcgtcgtcggtccaaagcgtgaaggtttgactagaatgagaatttgaagtttaacccctgcaaatattatattgaagggaaatcatggtccaaaatcaagtcgccacccaagttaaagtgcaatgtaatcactttagcttg

SEQ ID NO: 415 - DNA, 413 bp, Pinus radiata
caaattcttgtactccacctgcaacgtttcaaggtaatcgatctatgagtgtttttgaaactggaaatgagcgtaaaagaccagctggcaactcctactcggccttggaattgtctgatgacattggggatgaagatggttctgatgattgcatccatttgggagagaaaaaaagaaggttgaccttagagcaagtgagggctctagaaaaaaatttcgaaatggcaaacaaacttgaaccagagaagaaaatgcaattagcaaaggctctaggtctgcagccaaggcaaattgcagtgtggtttcaaaacaggagagcaagatggaaaaccaagcaactagagaaggacttcaatattctcaagcacgactatgattctctgaagcaaaattatgataatcttatggaagaa

SEQ ID NO: 416 - DNA, 355 bp, Pinus radiata
ggagcacccaaaatggggaagacgaagatggagatgaaacacattcaaaaccctagccgccgccaagttactttctcgaaacgcaagaacggattgctaaaaaaggcattcgagctttctgttctctgcgatgctgaagtcgcccttatcattttctcggaaactggcaagatcagcgagtttgcaagccacaacgacatggcaacaatactggaaaaatatcgcatatacacgcaaacagaaacagatggaaacatgggggcttcgtcggtccaaagcgtgaaggttggtgaatcacaattgaaagcgttgcacgagaggatggacaatttgaaaaaaaaggaacgaaacatgg

SEQ ID NO: 417 - DNA, 661 bp, Pinus radiata
ctcctctctgcagagccatacctcctcaatatgctttgcatctcttcttcgttttgaattctcccgtctctgcctaagtaaattctcacaataatatatacagccattctctccatatttccgtaatcggatgatacttctggtttttctgttgctgtcatcgtgagaaagatttgcgtttgtgtgtttgctgaggaaatttagtgttggtagactctcgaagcgtatagctgagagtctttaaacatgggtattatggcttgctcactgggatcccgtatgcctactctgtggagcacaagcttctttcgtcacaagcactttctctagtagagctattatcagaagaactttaggaagcaaggggtagttgtctgtattaaataaaaatggcgtccaatgggattatgttcaatgcttccaatcgaaatttgatcgtcatggtgaatgaagctccatccttcgaagctaattcaagtttggatggagtgatgaagaatgtgtcaaagaggccattctacaatacacttgatgcagacgaagcaggggatgaggatttgctggacgagtgcgttcatcagccaggaaagaaaagaagactttcggtagagcaagttcgctttctggaaaagagctttgagttggacaacaagcttgagcc

SEQ ID NO: 418 - DNA, 323 bp, Pinus radiata
tctagaacgaagcatacgacaacagcgcgcatttcaccacttaggattgatggagcagcacccttggcgaccgcagagaggacttcctgaacgctctgtttctgttcttcgtgcatggttgtttgagcattttctgcacccgtatccaactgatgcagataagcatatattggctaagcaaactggccttacaagaagtcaggtatcaaattggtttataaatgccagggttagactatggaagcccatggtggaggagatgtacatggaagaactcaaggaagaaaaagtggaccaaggtacacacaattctgaagctgaaa

SEQ ID NO: 419 - DNA, 1571 bp, Pinus radiata
gttgttttctgtacagtgtaacatggatatctgatgttcgccacagtgattcttatggatcatacatatatatatttcaaccaggtctgatatatatttgtgggaatcatatctaatactgaaagcatttgctttctgctgctgctgtgatctattcctatgttctgtattcgaatatgatagattacctttactcatatgaagcctctgctgctgctagttagtgtatttatgtttcagtatatatcttattctgctcatgccgggtattttatgctgtggatatggtctgggaattaagagtaaccgaggctcaagaggccgaagctcttagaatcttgatattttaatgtttatctttttaacgtcctttgagatttgacttggccttggctggattggcggatcatgtgtgaagaagattttgttattataaatcaagtttttttatacatgatcatgccaacagcaaattgtaatgagtcatggtcctaatggtggccattcttacagtttgtaggagccaggcatccttcttgtagactttgaggcagcagtcttgttgttcctgctattaagggatatggctatgagctaattagaattgagggcaacaatggaaacgaatctcttaacgcagcaacaatcaggttgccatgatgctgaagaggactatgatggtggttattgagtgttgattaaataacagaccccccaacaatagaaacagaacatcagttggatgctggttatagttgagacagttgggttatgactgtaaaactgaagacattggatggcaatggatttgagtcagaatggctgcatgacagtggttatactttgatttagctggggttgtggtgatggatatatggcagccgtggttttggattttcatgggagtggctgcttgatcaatatatggcagtttctacttatgtggactagtatttcacaaaggggaatgcctatatggaagtagttttataaccatggttatggatttaagtttgatcaattgtatgaaagtgtgtacatggctctagttaagggcacgaggataggaagctctggatatggacttcagcttggtggctgtatgacactgggtgcctttatatgcttaaggatttgagttgggttcattgatttcattttgttgcagataatttgagaagcaatccggggatgaatctaaacgatcatacttacaatttatcacctatggctaattcaggaaatcctgaagagcagattgatgaggatgcagtggatgactttatgaactaccaacccgagtctaaaaagagaagacttacagtagaacaggtgaggtctttagagaggagtttcgaaatcgagaccaagctggaaccagagaaaaagatacagttggctcaagagcttggacttcaaccccgtcaagtagctatttggttccagaacagaagggcgagatggaagaccaagcagcttgagagagattacagcgttctcaaagctagttatgatgctttaaaatctgattttgagagattgcagcaggaaaacaaaaatatccgtgccga

SEQ ID NO: 420 - DNA, 339 bp, Pinus radiata
gattatctcatcacaaaaatctttaatttgctctttgaaccattctgcatcatgtttacaataagtacctgtacaactcacgcacaatctctgatatacagttttgttgcgaggggcaccgtggtgcttgcggagtacacggaattcaaaggcaattttacaggtattgccgctcagtgtctgcaaaagcttcccgccagcaacaacaagttcacatacaattgcgataatcataccttcaactaccttgatgaagatggcttcgcatattgtgttgttgcagatgaatccgttggaaggcaagtaccaatggcatttctggagcgtgttaaggaggat

SEQ ID NO: 421 - DNA, 332 bp, Pinus radiata
tgggtgcccaggcaatattcatgatgacgatgaagaagaagatgaggaggagtgcagcgggactgggcagcaaacgaggaagaagaggaggctgagcttgcagcaggtgagatctctggagaaaacctttgaggttgagaacaagcttgagccagaaaggaaattacaacttgcacaggaattgggcctccagcccagacaggttgctgtttggttccagaataggcgtgctcgctggaaaaccaagcagctcgagagagattacggacagcttaaactcaatttcgagtgccttaaatcgaacttcgatgccatcaagcaggaaaaccaga

SEQ ID NO: 422 - DNA, 461 bp, Pinus radiata
ctgaagtgccgtcgattgttcgggaggatagcgttttcgaagttcgttgttgagttatctcgcgagactgtagaattttagggttgttttccacaaaccgacttttcccgacttcaaatcttgatattgaagtgacatggccggcgagaaaagaaagattaatagaatagctaacgcttcggccaggcaggtcaccttcgcgaagaggcggagggggctgttcaaaaaagctcaggagctatcgattttatgcgaagccgatgtagccctcctcgttttttcttcaactggaaagctgtaccagtactccagctccagcatgaaaatgatattggaccagtatattttgtattctagatcaattcaaaaggatggaaagccaaatctggaggagagtcacgatatccaaaagataaaacaacaaattaaagatattagtcaaaatttgagaaaactgcgtg

SEQ ID NO: 423 - DNA, 622 bp, Pinus radiata
ataatcctctcctacatattgcctcttcctttcctctcttcttcatcatcagtcaattttcccttggagattttacattcttaagaaacagatgggtatggatatggaggactgcaatacagggcttggtctgggaatgagtattggccttgggatgaatctaatgagagaagaccttcaatctcacagacatcatgtcaatggccctcctgtgcagttggatctgctgcctttagctccagtactgccgtcccgtgacttgccatgggggaagacttcacccgggactgatggcgagagatcggccggggaatcgaaagcaaccgtgcccaggcgaatcgatgtgaacaaattgcccgcttcctgttactacaacgaagacacgggcaccattaatgtgtcgtccccaaacagtgccctatcgtcgtttcatgtggactccggtggcgcgatcaacgctgagagcagctgctacggcatgagcgtcaagagagagcgcgaagccaccgaggaattggaggcggagagagcttgctctagggttagcgatgaagaagctgatcaggagggcggcaccaggaagaaactcagattgtccaaggagcaatcggctcttttggag

SEQ ID NO: 424 - DNA, 373 bp, Pinus radiata
attcaaaatgggaaagaagttggagctgaaacgcatccaaaaccctaatagttcacgtgattccttctccaaatgcaagaggggactgctaaagaaatcggtcaagctctttgttctctgtgatgctgaagtttccctcatcattttatctgaaaccgccaagatttacgagtttgcaagcaacaagtcgtgactagctcttgtgaattcttctgatcaagttagagatccatatactgatatataaaagcatactttcacattgcaattggagcagatctagatgcagaagtgcaaccttattatacctaaaggccatcagctgcaaatcaagacccattttctatcttttgagatcgtgatacagagtctg

SEQ ID NO: 425 - DNA, 440 bp, Pinus radiata
ttcgatttcaggctcaagacttccagaagcagggaacacaacttcgccgaaaaatgtggtttcagaacatgaaagtcaaactggttgttcttggaattgtctttgtgttgattcttataatctggctctcaatttgccatggatttaagtgccattaatcttgattacttggcagtcctttctagatacaatcctttcgaggcatttatattcattttttggcagcttggcttataatagatgcaggctctctttgaaaagagtatcttttgtgttgtgtctgagtaatgtatttcattcacttggatactgtcatcattagatactgattatctatgtttttctctgacgagggacaatgcctcgactcttcatagtttaggttattggcactacccatcagctgtgatgtcaatctcttttataaatatgaatccctg

SEQ ID NO: 426 - DNA, 280 bp, Pinus radiata
gtttcactcgttctgccccgtctggattgggctgcactgaaatacattgaacattggagttgtcgagcgcgagatatgggtcagcagtccctcatttacagctttgttgcaaggggcacggtggtcttggccgagtacacccaattcacgggcaatttcacaacaattgccaatcaatgccttcagaagattcctgccagcaataataagttcacctacaattgcgatcgtcacacattcaattatctcgtcgaagatggttcacatactgtgttgttgc

SEQ ID NO: 427 - DNA, 539 bp, Pinus radiata
caacagcgaagccgatttccaaagatggatagggagaaactcatgaagatggctggtgcagtccgcactggcggaaagggtacaatgcgaaggaaaaagaagacaattcataagactgccacggcagatgacaagagacttcaaagtaccttgaaaagaataggcgtgaataacatccctgctattgaagaagtcaatatttttaaggatgaccatgttattcattttgctaacccaaaggtccaggcttctattgctgccaacacatgggtggttagtgggtcatcgcaaacaaaaaaacttcaagatcttttccctggtatcatcaatcagcttggaccagagagttttgccaatctgaggaagattgcagaccagtttcgaagaccggaaccaaatcctgcacagggagaagatgatgatgatgacgatgtaccagagctcgttgaaggtgagacatttgaggaagcagctaagaaagactcctcttaaattttaatagatgagggggcatgggatgtggaacaagctagactgaa

SEQ ID NO: 428 - DNA, 1020 bp, Pinus radiata
cattagcgcaaattcattcccctttttggctcctgccgagcttgggcagattacagagaaaccctagtctcgtggattctcgatcgaaatctgcacggcctgtatacagtcttagcacattcactgagctgccataggtttcttggaactcttttttccgcggctcttgcgagtttcacaggtttttgtttgattgtattttgagggtttttctttcttcgagggttttgttttcccgtttttgtccccttattctttcaagacatctcagaatgatgcagccagccgtcggtgttgctcctccccctcctgttgctgcacccgcaatggatccccagcagcagcaacagcaatggatgatgatgcagcagcagatgcagcctcagcaggctcagcctcagccgcctcctcaggctgggttttggcccccgcaacaccaaccccaaccccagcatgcccaatcgcagcttatggctcagcaatacccgcagcagccgacctcagctgacgagattagaaccctgtgggtcggagatttgcagtattggatggatgagacttatctgcatggttgttttggtaatagccaagaggttgtttctgttaaaattattcgcaataaacagactggacaatcagagggttatggctttgtagagtttgcaagccatgcaggagcggagagagctttgcaaacttacaatggtgcacagatgcccaacactgaacaattttacaggataaattgggcaacctttggcattggagaaaagcggcctgagattggacctgattatcctatatttgttggagatttagcatctgatgtgacagactatttgttgcaagagacattccgaactagataccaaactgtaaaaggagccaaggttgttactgatagggttacaggccgttcaaaaggatatgggtttgtaaggtttggggatgagaatgagcaagttcgggctatgacagagatgaatggggtgttttgttcctcaagacctatgcgaatag

SEQ ID NO: 429 - DNA, 246 bp, Pinus radiata
gcctcttttggtttaggagaaagacgccttctaacaggaccagagcattctatatttgtaggagatttggctccagatgtcacagattatctgttacaagagacgtttcgatctcgatacacatctgtgagaggtgcaaaagttgtaacagatccatccacaggccgttcaaaaggttatggatttgttaagtttgctgatgagaatgagagaaatcgtgccatgactgaaatgaatggtgtttat

SEQ ID NO: 430 - DNA, 323 bp, Pinus radiata
caaggcaagagccaagtctaaagaagcagattatagagacatcagagaaagccatagttttctcccagtggactagtatgctggatttgcttgaggttccactaaaaaaatcgtgtatacaatatagaaggctggatggaactatgtctgtaatagcacgggataaagctgtgaatgatttcaagacactccctgaggtaactgttatgataatgtccttgaaagctgcaagtcttggtctcaacatggttgctgcaagtcatgttcttctgcttgatctttgggtggaatcccaacaactgaagaccaagctattgacaggg

SEQ ID NO: 431 - DNA, 414 bp, Pinus radiata
ccctcggcttcgaagactacgtggagccgctcaagatatatttgaataagtacagggagctcgagggggagaagtcttccatggcggcgccgcccagacagagcgacctgcagcagcaccaccatgtgaacggaagcgatccgcatccatatggccattcgccccacggtcctatggcttaccacgtgcccggaggtgcgagctttcgggcatggaaggtgactgtggcgtgttcattttgttattgtaaagaagtgatagagatggaaatgggtcatggtaatggagactgtaaagtttaaactataaaatgtaaagttgaattcctctctgatgttcagtgtttactttttttgaattttattttttgcccccttttgcattgtacagtctgtagctgtgcatgactgactg

SEQ ID NO: 432 - DNA, 525 bp, Pinus radiata
ctgaaatatcgttaaattcactcttttggtctcagttactgcgtcgccaatatggaaaatctccccaatcagcaacctgaccttgaaattgctcaaacacacgaggatcccgggtcccgccaatttaagggaattcgactgcgaaaatggggaaggtgggtatcggaaatccggatacccaaatctcgagagaaaatatggctgggctcttacacgactcccgagcaggctgcccgtgcttacgacgccgcagtgtattgtctgaaagggcccaacgccaaattcaactttccggaaaccgtgcacgacattccgtctgtgacttctgtttcccgtcaggaaattcagcacgccgccctcaaatatgccttgggccagccccctccgagtttgcagtctctggaagggcacgccgccctcaaatatgccttgggccagccccctccgagtttgcagtctctggaggggcacgccgccctcaaatatgcattgggccagccccctccgagtttgcagtctctgcaa

SEQ ID NO: 433 - DNA, 1196 bp, Pinus radiata
ttcgcttccgaacataagcgcggttccagcgttcgtaacaaacttttgtggcccctttttatcgggagatcgcgggttcgagtccgttcttgtgttttctccgcgtccggagcactcagttcaggtgcccaaaaattgatcgttttcggtcaaatttcgttaatttccgaggacgacttgctagttgtatggttttaattttttttttcaacgaagaaaagtattaaaaattccagcatttacagttttgaggctcatagaccgagggaattgcgatataaagcaaccttctgccctttagctggcaccggcagcagaacgggttggaatggagttttagaagtatcagattgactattcgctgtagaaaaggcaagagcctgtctgaatccgcattggagctgccagatcttgtattctaaggcaaacactggggcgagaaagatttccacggccatttagaaaccgagggctcaaggaccattattttgcaataaaatttctcggatcgtggctatggccttcaccggaacgcagcagaagtgcaaagcttgtgacaaaacggtttattttgtggatcaactgtccgcggatggagtttcttaccacaaggcttgcttcagatgcaaccattgtaagggaacgcttaagctgagtaattactcgtcaatggagggagtgctatattgcaagcctcactttgaccagcttttcagagagagcggcaattttaacaagaactttcagtcccaaagatcaagcaaagcaattgacggtctttctcctgaaatgacaagatctcctagtaaagtgtccatgatgttctctggaactcaagacaaatgtgctacctgtggaaaaacagcataccctcttgagaaggtcactgtggaaaacttatcctaccacaagtcttgtttcaggtgttctcatggggggtgttcaatcagtccttctaattatgctgcactagaaggcatactgtattgcaagcatcatttttcccagcttttcaaggaaaagggaagttacaatcatctcattaagactgcttctatgaaacgagcagctgcagtccctgaggtagcaagtgcagttcctgagatataattttactgtgatctagttacttcattaccatttgtgtttgtattttgaagagtttacacggtatgctagtttgttggggaaaagag

SEQ ID NO: 434 - DNA, 726 bp, Pinus radiata
gttcaattttttcacttgcagtggaaatagaagcctgcaggtacctctaggctaccggagttcaaatcccgcacgatcacactcccttcttttaacattccgagttcgaatccccggaaacttctcgacatggttaagccctcgcaaaaacagaatatccatgtcaatggcaagccggaaagccgctcactgatgtcgcggcaattcaagggaatccggctaaggaaatggggaaaatgggtgtccgaaattcgaatgcccaattgcagggccaaaatttggctgggctcctacgaatccccagagaaagctgcccgcgcctatgactttgcagcgtattgtctgagaggatccaaggcgaggttcaattttcccgactcaccgccggaaattccttgcgcctcttctctatcgccgtcgcaaatccaagccggtgcggcccggttcgccgcagaagaattccagatgccgtcagatgacgacacggcgtcatcgtcctgcggttctgaagcggaatccgacttgccgccggaaattccatgcgcctcttctgtatcgccgccgccaatccaagccgccgcgcccaggttcgccgcagaagaattccggttgccgtcagatgaggacacggcatcatcgtcctgcggttcggtaacggaatccaacattgacagccaacagatttcggcggagcagggttcggcattttgggattcactattcctg

SEQ ID NO: 435 - DNA, 266 bp, Pinus radiata
catcaatggcatcgcttttgttcccgcaggctatgctgcactgccctgcacaatacacagaagcaatgcaccaaatctgcagccacaggtaagggcgggatcaagaggattcgtaggcaacaggaggctgccccttcgccgccagaggaggcaactttgaatcagcaaactccaccgtacagaggcgtgcgtcgtcgcaactgggggaaatgggtgtccgaaattcgagaaccgaaaaagaaaacccgaatctggctcggctcctt

SEQ ID NO: 436 - DNA, 1775 bp, Pinus radiata
acggaccagagatttccaatatcggcgtcgcaagtctttgagtatacgggacgattcccgccgtcgatcgtaattcgtagaatctggacgcggctacaaaatcgctgcccgactccaacgttttctccagttcggccagtgaggaagtttgagggttcacgttattgagagaggacgctatttggttgcgatttcgagtgctgtaagcaggcaacgacgcctgttttgctttagagtttaacagaaaagaagaatgtgtggaggtgctatcatctcggactttataataccccctgcgagccgaggccgccgggtgactgccagggatatatggcccgattttgataagttctctgagtttattaatggaggtgctgcggtggagtcctttgatgtcagcgttgatgtcgatgacgacgaggaggattccgacgatgacgagttcctcgattttgaggagagctatcagaacaagaagaagaagcagcaacagccgatatcccccaccaagggtttcgagcttcctttagctcggggtcttgatggaccggcggccaagagcgcggtgagaaagaggaagaatttgtacagagggatcaggcaacgtccatgggggaaatgggctgcagagatcagggatcccagaaaaggcgctagggtttggctgggtacctttaatacggcggaggaagctgctcgggcttatgatgcagctgcacgaaagatcagaggtaagaaggcgaaagtaaattttgttgatgagccaccaccctccgttaagaaggaaagtaataatgctaagggttccaagaaagggtccagcaagaaaataaaatcatatactaccccaaaggctgactttttcgaaggtttcaaaacggcgaacccttcgattgcccaatacaacttccatcagaaattcccaaaccctagctgtgatgatctagggtatcaaaaccccttgtcgccattacatgccatctgcaatcgaaactttgccgccaaacagtcaagttccgcgttgcctgcatactccactgagttttctgatttcgatgattccgaggtcgataatctggtaccccagcctgcgagttttgaaccgatgaaaaacataaataaacgaaaagggtataattcctttgagtccgacaccagcagcgtgtctgctgatagatcccatatctcgtgggttacagaagtgaaaacccctgaaatatcttctgtaccaaaagccgaagccgactctgatcattatgattttgctgatatgtctacgccggttgcgaccagtgtttcagcaggcagccctgaggtacagcttcctccatttaataatggtttgaacaaatcccctagtgttgaagatggcgtcgctgccgaaaaatcccctaaattggaggaaagttcacagttggagatctctgaggacttgccttctttggaatcatatccgtggttgttccagatgccgtatttcgagggcctggatcagtcgttgcagggtgtgggtattggtgacgcttcgtttccggacggtgagaacgacttgcagctttggagttttgatgccgtgcctatttccgattcagcttattgaattagccttgaatctcttgcttgtaaacagtaattagtaattatgtaagaatcaaggagacttgttatggcttcgttttgcaggccttcgtctaatagggaacttgtttagatttttccccttttttttttttaaattcagtttgacggtgccactgtgatttaatctgcacatt

SEQ ID NO: 437 - DNA, 585 bp, Pinus radiata
accttttggctacatcctcactatctttccatttggtaaagttgaaggggaccgagtgttattttagataaaagttaagacatttatgaaatccaaatctaaaaccagcaaaaaccaaactcagtgtcgatctcatcgatcagagtagaccacaagtatttctggtgtgaatcacatcggagatggcattcgcaggaacacagcagaagtgcaaggcatgcgagaagacggtgtacgtggtggatcagctcacagccgatggttcagtctttcacaaggcctgcttccgctgccatcattgcaatggcaccttaaagctcagcaactattcttcttttgaaggggtgctgtactgcaaacctcacttcgatcagctctttaagaggactggaagtcttgacaaaagttttgaaggaactcccaaagctgtgaaaaatgagaagttgaatgatggtgagattaagacacccaacagggtctctgctttgttttctggcacacaagagaaatgccttgcttgtggaaatacagtttatcccattgaaaaggtttctgtggaaggtgtgggataccacaaggcatgct

SEQ ID NO: 438 - DNA, 351 bp, Pinus radiata
gtttcggcctttggaagagcttctgaatgatgtaaattggaggtcctgttgccggcttagtccatgtattgatttgggttttttcacttttgggttttttcgatttctctggggttttagggtatggatggatctcagaacagcggcggcaatgcggtgcctccgtttctaaccaagacgtatgacatggtggacgacagctccacggactcgatagtttcatggagccccgggaataacagtttcattgtgtggaatcccccggaatttgcacgagacttgttacccaagtactttaagcacaacaatttctccagctttgtcaggcagctcaatacatatggcttcagg

SEQ ID NO: 439 - DNA, 292 bp, Pinus radiata
catgagaagaaggcagtattgtggaacatggatactctcaaagctaaaggttcccttgaagagcattcctttttgatcactgatgtgcgattcagtcctaattcaacgcgcttggctacatcctcttttgacagaacagtcaaagtctgggatgcagacaatccaaactataccttgcgtactttttctggtcatactgggtctgtaatgtctcttgatttccacccgaacaatgaagatcttatttgctcttgtgacggggaaagtgaagtccgttactggagtgttaacc

SEQ ID NO: 440 - DNA, 352 bp, Pinus radiata
aatgggctatttacaggaacttgaagatcagataataggccttcaaaatcttgtgaaacggaatgaacgcttatatggatctggaaacaccccttctggaggagtagctttaccatttatcttggttcagacccgtccacaggcaacggttgaaattgaaatctctgaagacatgcagttagttcactttgacttcaacagcacaccttttgagctccatgatgatgcatatgtgctcaaagcaatgggattttgtgaaaagccatttactgatggtatggatgttactggccatgatagttttgcaaatggaactggattcggagaaaataacatgactataactaacatg

SEQ ID NO: 441 - DNA, 441 bp, Pinus radiata
gacaagagtgttgctgattgatgaccatccactgttccgggagggactggcaggtgcgatccaggccgagccagatttcgaagtcgtcggccaggccgggaccgtggacgagctgcgcgggcttgcgccgcagatcgagccggacgtcgcgatcgtcgacctgttgatgccgtcggtctccgggatcggcgtcacccgcgagctgtgcgagctgctgcctaggtgccgcgtgctggggctgtcggccgtggtcgacgccgccgcgatcgccgagatgctgcgcgccggtgcgagcgggttcgcgctgaagacccagccggcgccggacatcctcgatgcggtccgccgcaccgtggccggcgagagctacctgccgccgagcgtgtcgcgcgaggcgatcgacgccgagctcgccggcggcgccccgccatcgctcgcgca

SEQ ID NO: 442 - DNA, 1056 bp, Pinus radiata
accgagtggagtggggtgtcctaaagggagcgatgtattattgttggtgcgaggaagcagatgagaaggaggggaggccggtgtttgagggttccagatgttccattaccaacgaaaaatccaggtaggtcttcattctattccttcaatcatggatccgccctactctcagtaagctatataagatcattcattcattcaatcaaatccattggagtgcctgttctggtatacttctttgcattggaggtcttggggtttgaccttactcgttcgttcctcgaagcccttggccgcttcccatttacaataacttgtgttgttgcggatttgcacatggtgtatgctgccgacccagaggaaccccggatcgtatattcttgtgactgtaacaaaataattcttgagggtttccgctacggcaagtttgaggcttgggattttgacccagatctgtgttgctgtttgattccgcaagcttggggagatcaggatctgctctttgttgtaaatgtcgatattacccaaatcagattccattcatattagggaagtatgggccgataatctggaagaggagtttaatctgatcagggaaattgttgatgactaccctctgatagccatggacacagagttccctggcatagttgtgcgacccgtgggcaaattcaggaccgtccaagaatacaattatgaaaccctaaggtcaaatgtagacgtattgaaattaatacaattggggctgacgttttctgatgaagacggcaacctcccaaactgcggcacggacagatactgcgtgtggcagttcaatttcagggaattcaacatctgggaggatgcttacgcctccgattccatcgagttgctgcgccagagtggtatcgatttcaagaagaacagcgaacggggcgtagactctcacctcttcgcagagttgctcatgtcgtctgggatcgtcttgaatgagaacgttcgatggatcaccttccacagtggctatgatttcggttacctgctcaagctcgtaatgaatcggagcctgccgcctac

SEQ ID NO: 443 - DNA, 367 bp, Pinus radiata
gagcatgcttgtcctatggcctgtcaccccgggccctgccccccttgtctagtgagcgtgagcaagagctgttggtgtgggagtaaaacgcttgtatcacggtgctcagtactcaacaaagggacgtcaacaaatgccggtgttgggcctgttctatcgtgtggtcaaccatgtggacgtctgctagggtgcgaaaagcatacttgcgagcaagagtgtcacccaggaccttgtccaccctgcgatatcgtagatgttgcaaagtgctattgtggtagacaagaaagggggatggcatgcgggacaggtatagtcgagacctgtgtagtagaaggagagggttcctgggaaggcagatggcaatgcg

SEQ ID NO: 444 - DNA, 553 bp, Pinus radiata
ggtttgtcagatttggtgacgagaatgagaaaaaccgagccatgactgaaagaatggtgtttattgctcttcaagacctatgcgaattaatgaagctacaccaaagaagtccttgggatttcaacaaccttattccatgaaaggtaactattacacacaggcatatggtggtgcagttgctagtcaggccttccagtcagacaatgatccaaataatacaactatatttgttggtgggttagatccaaatgcgacagatgaagatctgaggcaggtttttgggccatatggagagattgtgtatgtgaaaataccagtgggcaaaggatgtggttttgtacaattcaccaacaggtcctctgccgaggaagctttgcaaaagttacacggcactgttattggtcaacaatctattcgcctttcttggggtcgatctccagcaaacaagcagactgcaagctggggagtgcagcctcaagcagatccaaatcaatggaatggtggtggagcttattacggttatggtcaaggttatgaagcttatggttatgct

SEQ ID NO: 445 - DNA, 381 bp, Pinus radiata
gcagtatctgtctcctggcaaatcagctcctttttggctttgccaagatatggcaataacctctcaacaacatcatatgaatgctcttccatataacgaacgcagtgaaaaacgccccaaatttaagggaatccgaatgcgaaaatgggggagttgggggtccgaaatccggatgcccaaaaccagaacgaagatatggctcggttcctacgaaacggcagagcaagccgcccgtgcttacgatgccgccttatattgcttgagaggccccaacgccaaattcaactttccggacactgtaccttcaattccgtcggcgttttctctttcacgccaccagattcagctcgccgccgctagatatgcccgggacgaactgcc

SEQ ID NO: 446 - DNA, 516 bp, Pinus radiata
aaagatagctaggtgccgtaagtctcgcgcagttaaaagaagtcacgaactacaagcgatagtccactcgttttgatgtagtgccagagatcgactcagatagattccgatgttttgggtttctgtttttaaccttggaaggttcaattttacagtttctacgggaattctcatattcaatctgtttggcagattgaactaaagatttttgtccgggtgatttttggattaaattcaaggtcgacgaacgtgaggtgctagggcttttagagtttggatggaacccatggacatcgttggcaagtccaaggatgacgtctcgcttcccaaagcaaccatgtttaaaattataaaagagatgctgcctccagatgttcgtgttgcaagagatgctcaggacttactggtcgagtgttgtgtggagtttatcaatctaatatcttcagaatccaatgaagtttgtggcagagaggaaaaacgaacaattgcacctgagcatgtgctgagagccttgga

SEQ ID NO: 447 - DNA, 396 bp, Pinus radiata
gaaatatcactattttggcttcagagtttctgcaaattgccaaatatggagaatgttcccgagcaggaacctgacaataccatttctctgccacacgaagatcgcggttcccgccaatttaagggaatccgactgcgaaaatgggggagctgggtatctgaaatccggatgcccagatccagaaagaagatctggctcggctcatacactacccctgagcaggctgcccgcgcttacgacgccgcagtgtattgtctgagagggcgcaatgccgaattcaacttttctgtgcccgacattccgactgcgtctcccctttcccgtgagcaaattcagcatgccgccgccgaatatgccttgggcaaagccccttccagttttccctctttcgcaggg

SEQ ID NO: 448 - DNA, 946 bp, Pinus radiata
ggggagacgagatctatctaccgccccctttgtattcatggtctcgggaaacataacaagccctggtcggatcagagaggctcagacaaagatagcgggaatgaattaggccgcactaatttgaatcccggccaaataccgcggcggaggacgaggacgaccacactccggcctaaattcgccgccttttttataattaaaaacataaaaaggccgacgccatgaacgaaccagacgagcacgccgctgctcagctcgtgcagaagcgtagccacccgctggcggaggtggttatgcccatctccgtccgtccgctggcggagaaatgcggcgtggaggcggaggaggagaggaagcgggcggcggagcacaagaagcagcggtccaagaactggacgcgagcggagacgctgaaactcatccgcctgcgagcggaaatggagccgcggttcgcgcgcagcgggcggaagtcggagctgtgggaggagatcgctgaagcgctccgccgagagagcgtggtccgagacgcgcagcgttgcagagacaagtgggagaaattgacggcgagctataaggaagtccgcgacgggcagcgcgacaggcaggacttcccgttctttgacgagctggacccgctgctatctctcaagcctcagaaggcggcggcagcggccgccgctgccgctaccgccgccacggcggcgaattttgtttccgccgagactcccagcaattttccgactgacgacgagatgacggaagaagggtcccctgctgggaagcggagaaaaacgactccaagaggcctctcggcgacggacctggacgctgttcgtgagctcctggagagcctggtgagtcggcagcagaggtttttcgtggatctgctggattccatggagcggaaagaggaaatccgcgagcggattcgtcaagaaaaggagga

SEQ ID NO: 449 - DNA, 1140 bp, Pinus radiata
gctttatggagttcatatcacgtacagcagctgagaagattatgcaaacttataacgggacattaatgcccaacactgaacaagctttcagaatgaattgggcatcatttagcatgggagaaaggcgtctggatggaggtccagattattctatttttgtgggagatttggattcagatgtctcagatttggtcttgcaggagactttccaaactcgatatccatcagtgaaagctgctaaggttgtcatggatgcaaacacagggcgttcaaaaggttatggatttgtgaggtttggcgaggagagtgagagggcccgagccatgacagaaatgaatggtgtatattgttctactagacctatgcgaatcagtgcagccaccccaaggaagtctgcaggagttcagcaacagtattcaggaagagcaggcaatggtggatctcatgcccaaggattcccgtcagacaatgataaacaatacaactatatttgtgggacggctagatccaaatgctacagatgaagatctgagacaagtctttggccagtatggtgatcttgtgtccatcaaaatacctgttggtaaaggttgtggatttgtccagtttgcgaacagggcttgtgctgaggaagcattgcaaaggctccatggtactgttattcgtcagcaaactatacgcctttcttggggtcgaagccctgcaaacaagcagaattctcagccacaggggcaacagcctcagtctgatccaaatcaatggaatggtgcttactatgggcaaggctatgaaagctatggttatgccccccctcctcaagatcctgcaatgtatgcttatggtggctaccctggatatgggaactataatcagcaggtaagctagagttacaagtctctaaagcttggtcacactaatgttgcaagggctgtttatttgcccttcaagttggcttcatttgttttcagtctggaggctgcaattgttttgttttctttaccaggtatagcaacgtatttgctagttgtgtaagcacataaaaattattgcttcatattcaggttttcattatctgagatcaacatatattttccctagttatattacatatttccttataattttaaaaaaaaaaaaaaa

SEQ ID NO: 450 - DNA, 390 bp, Pinus radiata
acatcataccaccgaccttgcttcaagtgctgtcatggtggttgtgtcatcagcccctcaaattatgttgctcatgaaggcaggctatattgtaggcatcatagctctcaactttttagggagaaaggtaacttcagccagctttcaaaggcaacacctacaaaaggggtgactgagaactcagacacagacgacaagtgatcattcgggccagatttttgttgagagagttgtagtgtgtaattgattcatttcatacatttgatatgcaagcctgtatcaagcttatcgataccgtcgacctcgagggggggcccggtacccaattcgccctatagtgagtcgtattacgcgcgctcactggccgtcgttttacaacgtcgtgactgg

SEQ ID NO: 451 - DNA, 460 bp, Pinus radiata
gagtaggaggcggcggcggaggcaagggaagcccgtacagaggcgtcaggatgagaaaatggggaaaatgggtttctgaagtgagggagccgaacaagcggtctcgcatatggctcggctcctattccactcccgaggccgctgccagggcctatgatactgccgttttctacctcagaggaccctccgcgactctcaatttccccgaggaagcacgtaaggagcagcagagcgacctcaggctttcgcagctcggggagctctcaccgtcctctattcagcggagagcggccgaggtcggcgcggccgtcgaccatgccatgcaggcgggcccggttcctgctcagaccctgagggaaataaaccaagaaaatgatatgaagaacgccttgagctcaaaattgagcgagggcaataatttcaagatcgaagcaaaaaataatatgaggcagcagggctt

SEQ ID NO: 452 - DNA, 1116 bp, Pinus radiata
gtagatttaaatgcttttttgaaatccggttactcgcaagattatcaatcgggactgtagccgaagctttgagaggttgaaattcagacttttgctccgaactgttctgctgaaacaaaatccagtattgagctaggtttagaatcgggtttgctggtcatctgggagaggcgatccattcagcttcgcaggcccccgaagatggcgttcgccggcacaacccagaagtgcaaggcatgtgaaaagacggtctatttggttgatcaattgacagctgataattctgtttttcacaaatcctgtttccgctgccatcactgcaatggaactttaaagcttagcaactattcgtcgtttgagggagttctatattgcaaacctcattttgaccagctgtttaagagaacaggaagtttggataaaagttttgaagccattcctagagcatcaagaaatgacaagatgcatgagaatgagaacaggacacctagtagggtatcagcattgttttccggtacacaggataaatgtgttgcatgtgggaagacagtgtaccccattgagaaggttgctgttgatggtacatcataccaccgaccatgcttcaagtgctgtcatggtggttgtgtcatcagcccctcaaattatgttgctcatgaaggcaggctatattgtaggcatcatagctctcaactttttagggagaaaggtaacttcagccagctttcaaaggcaacacctacaaaaggggtgactgagaactcagacacagacgacaagtgatcattcgggccagatttttgttgagagagttgtagtgtgtaattgattcatttcatacatttgatatgcaagcctgtacaatagcctgtgactgttaagggcattcttttgtctccctgttgctatttgggtttccggtgtgttcattttcacttatttttgtgttttagctggaagaatttgagagggtagaattgtgtcatcgctatggcttgtgcatgactcatgagccagcagttgagacttttatttattagttatagtactatatctagtcgagttctcaataaaagatagtgttatgctgttgggcagcaaaaaaaaaaaaaaaaa

SEQ ID NO: 453 - DNA, 439 bp, Pinus radiata
ccggttcctagttcgaatccttgccctaacgcagtcccgtgttttaagactcaatctttagtgactcccccgcaacatggttaagcccttgccaaaacagagcagcccgagcggatcggaaaactgccaaataaagtcgcggcagttcaaaggaatccgactgagaaaatgggggaaatgggtgtcggaaattagaatgccgaattccagggccaaaatctggctgggctcctacgactccccggaaaaagctgcccgcgcctacgactttgcgttgtactgtctaagagggtcgaaggccacattcaattttcccgactccccgccggaaattccatgcgcctctgacctgtcgccgccgcaaattcaagccgccgcggccaggttcgctacagaagatttccggctgccgtcggaagaggacgcggcgtcctcctct

SEQ ID NO: 454 - DNA, 481 bp, Pinus radiata
gcaattcctagtctcatttcagtgattcactcactgaaattattgttagaatcactgttttggccccagagcttctgcgtcgccaaatatggagatacgcctccagcaggaaaacgaccaggacattgctccgccacacgaagatcgcgtgtcccgccaatttaaaggagtccgaccgcgtaaatgggggatatgggtatcggaaatccggatgccgagatctcgacagaaaatatggctgggctcgtacaaaaagcccgagcaggccgcccgcgcctacgacgccgcagtgtattgtctgagagggtcgaacgccaagttcaatttccccaattctgtgcccgacattccgtctgcgtcttctctttcccgccagcagattcaactcgctgccgccaaatatgcgttggatcagtccccttcaagcccgccgtctctgaacaataataaagaggaacccgcgtcaccgtcgcagtcgtct

SEQ ID NO: 455 - DNA, 382 bp, Pinus radiata
ctcccacctccatttcactctgccgagtccattactctccctatcgtcgaaccacgtctttctcatcgaccaacaatgactcagcagacaacctcaccaacagttagtcccgccgcacttgctcttcccacttctgcctcatccacatctgcaaagtctgcagctgttccagtaccagcccaagccaaccctcgcaaacgtcctcgttcggatctctccgcagaggagaagcgagaggctcgtgctcatcggaacagaatcgcagctcagaactctcgtgacaaacgcaaacagcagttcactagtctcgaacaacgagtcatcgacctcgagaacgagaaccgccaattacgagacgctctcgccacttcgcagccgaacc

SEQ ID NO: 456 - DNA, 201 bp, Pinus radiata
aacttctgactatttttgaagctgtatatgtacataaagggatcgttaatgcagcgaaagtgcttaatctgaccccctcggcaatcagtcagtctattcagaaactgcgcgttatattccctgacccattgtttattcgcaaaggccagggtgtcactcctaccgcatttgcgatgcatctacatgagtatatcagtcagg

SEQ ID NO: 457 - DNA, 435 bp, Pinus radiata
gctctggggacttggtgttttctcccaatcctaaaactaaatgttattatctgaaatagggaaacaagattacagcagcagcgaaggacaaatgaaagggccgcaggggattagcaatgctcaaaacacttgtaccaaattccgaatgccaacatcagagaacttgattcccattcgccttgatattgaaattgatggactacgtttgaaggatgcatttacgtggaatgtaaatgatccagattcagagattcatttatttgcaaggagaaccatcaaagatttgaaatatccgggaagtttcataacaccagtagtacaatctattcaagcacagttagcagagtttcggtcatttgaagggcaggaaatgaacacaggacaaaaagtgctcccccttaagcttccctaaaatttagtatatatatcctcctt

SEQ ID NO: 458 - DNA, 654 bp, Pinus radiata
aaagctagataacgtttcgttttaaatacagcgcggccgaggcggccggtcagtcaacggggtttctagtgcggtcgtctatattttctactctcctttccactctgcaaaatcagaccttcatccattccccacggcattagattcaatccattctattaggctcctttaagcgaggtcgcgggttcgaacccgatcgaatgatgcgaattggataccgtttggtgtagaattctgatagatttcgtgcgatggagggttcacagaacggcagcagcaatgcaccgccccctttcttaacgaagacgtatgatatggtggacgacccggccacgaatgctatggtgtcatggagccccggaagcaacagttttattgtgtggaatcccactgaattctcccgtgttctcctccccacttactttaagcacagcaacttctccagcttcgtcaggcagctgaatacatatggttttcacaaaattgatccggaacggtgggaatttgcaaatgaggggtttctgcgaggtcataggcatttgttgaaaaacattcacaggcgcaagcctgttcatagccacagtcagcagaaaggagagagtttgtctggaggatcatgtgtggaaatcaaacaacttgaagatgagactgaga

SEQ ID NO: 459 - DNA, 675 bp, Pinus radiata
aattgaatcggccatggttttgtatgaattgttacatgtacagcagattcagcaaatacagcagcagcagtttcaattgcaacaacaacaaatagcagcagcggcttcaatccaccatatgggtcgaaaccctctgggtcccagagatcagcccatgaaacttcatggcagcagcctatcaaagccggctaagctttacagaggcgtgaggcagcgccactggggtaaatgggttgcagagatcaggttacccagaaacagaaccaggttatggctggggacttttgatactgcagaggaagcggccatggcttatgacaaggctgcttacaggctgaggggtgactatgccaggctcaattttcctcaccttaaacaccatttggaagcaaattccttcgccccctggactggtaattctgtgctgccatcgtctgtggatgccaagctacaagcaatttgccaaagcttgaaacaacctttggaaagcatgtctaagaccgaagaatcagaagaaatttcatgtgcatatgagaattcgggctctcttgggtcggtgcgggatgaagatgcgaagaagaatgatgttgtctctgtcaagtccgagacttgtgattctgatagtagtgatgattccaccattacagcgttgaattcatctggggatcagaatcc

SEQ ID NO: 460 - DNA, 1014 bp, Pinus radiata
cccggatagaagcccccggtcggagaacgaatccggcggcggtcacatgggcggcagcgcatttctctgtgaaagagcaggatcggttcctgcccatagccaacgtggggcgcataatgaagaaggccctgcccgccaatggcaaggtttcgaaggatgccaaagaaactgtgcaggagtgcgtctctgagtttatcagtttcatcaccggcgaggcctccgacaagtgccaacgggaaaagagaaagacgatcaacggcgacgatctgctgtgggcgatgacaaccctggggtttgaggactatgttgagcccctcaagatctatctccacaagtacagagaaatggagggcgagaaggtctctatggccaaacaaggagacccgactccttccaaggaaggtaacaacgccattaatggctcctcaattgaaaaccctaatgctaatgcctacagtggtttgaaccccggcggttataatagggtacagtcgcagtctctgccacatatgcagcaggctgcctatgggcaaccgccaggtggaatggtctatggccaccacggccacattatgggggcttacaatatgaccgccccaaatagcagtggtggaaatagcagtggtcagcaacagcagcaagcccccagaggccaatggtagaaatatttactttttcttttctgtttttctaatttttacgggtcatgtggggacagctggtgccttagttaaagtagaatggcatcaccaacccaaccaattctttactagtttttggctgaaatgattccatctcttgcatattaaagaagcccctcaagctcaggaggggactttgaagtgctaaagaagtctctcaagctcagaacactggaaaaatgggcgggttgttgttactaactgttctgtaaaaatttaccagaaatgttgttcaaactgtctgtatttagtaggtactgaatcttagtgaatctgcttctgtatatctattttcgctccatttggaagatag

SEQ ID NO: 461 - DNA, 301 bp, Pinus radiata
ggctgcaccactgtagtagaaactttagccaagtggcaggagctgaacagccaggtggaaagctcaaaagatggcgcgaaaagactcaggaaagcccctgccaaagggtcaaagaaaggttgcatgaaaggaaagggtggtcctgataatggacgttgcaactatagaggagtcaggcagagaacgtggggaaaatgggttgcggaaatcagagaaccgaatcgtggaagtcgactgtggttgggtacgttctcttcagcggaggaggcagcacgtgcttatgatcaggctgcgagggtta

SEQ ID NO: 462 - DNA, 384 bp, Pinus radiata
gttcagagggtaagtgaagattcgaaaaacaatggagattgtggggaaggccaaggaagatgtttcactgccaaaagcaactatgaccaagatcatcaaggagatgttaccagcacatgttcgtgtaaccagagatgctcaggatcttctagttgaatgctgtgtagagttcatcaatttaatctcgtcagagtccaatgacatatgctacaaagaggagaaaagaactattgcaccagaacatgttctggaatctctaaagattcttggctttgggagctatattagggaggttaaagctgcttatgagcaacacaggattgagaattgggattgtccaagagcaggaactagatggagtaaaaacagattggaaatgacaga

SEQ ID NO: 463 - DNA, 484 bp, Pinus radiata
gaatatcaatggggttgctgggggagttgccaaagagaaaaaggtaaattttccatggtgtgcattggaaaagcaagtagggacatcatcttttgatccaaatttggcttctagcaaacaagcaatggatagtctaatcatgcagcaactgcctaccttcctccaatattgcaaagatctagaagagggcagacagtcatggtttatgcacaagaaggaagctacctggaggctcagtcggcttgagcagcagcttgaatctgagaaagctcgcaagcggagagaaaaaattgaagaggtaggttcaaaaatacgtgccctcagggaggaagaaataacatatcttgacaaactggaaactgagtgcagggagcagctttctagtctccaaagggatgcggaaatgaaggaggctaagatgatggaattgtgggctaccaaacatctgcagttgacaaaattcgttgacagtgctttatcagtt

SEQ ID NO: 464 - DNA, 1434 bp, Pinus radiata
atggttttaggttttaaatgtagagcaggacgtgcctacttttgcttcatttatgcatatgtcttttgttgtcactattcgtctttaatccccactttgcctgcctggagagaagaggagaggaccctgccctgctatttggccttgtgagcgattcaggagaaatggggtggcaacagcagcaaggaggagagaatgaaaattgaataaaacgaaggatctgaatcccccttgcgcgcaagcaatggctcgagagaccaattcttttgccctactgggcggagatgacgaccaaggcgatgatgatctcatggcactcatcaacagcgcggccaccctcaagccagaaaagaagcccaagactactgccaagaaaaacggccagcagcagccgccgcccccccagtctcagcctgctaaacttccttccaaaccccttccgcccgccgaagccgtgagggcggatagaggaagaggaaggggcgggcggggccgcggtggaggccgtggcagccgctttgagggcggtgaatacaacaccgagagcaacggatatggtggtgggggcggttttggaggcggccgaggctggggtcgcgatgaggactctgggaaccgaggttggggtcgtgaagaggacaccggaggccggggttggggtcgaagcaacggcgaagaggacaccggtggccgaggttggagtcgaagcaacggtgaggacgacgctgctgcaggcggaggacagagccgcggcagaggacgtggacggggcaggggccgaggctttggtggtcgtggtagtggacgcttcggtggaggcggcgacagctatggctacgatgccaatggacaggaccgccctccccgtcaacagttcgaagacaccaataccttcacaggcacagacaactgggatacccctgaagtgtcagtcgttgatgaagctaaaaatgtggagcctgaacagaagaaaccagaagaagaggctacaccaggggttacctctgaaaataaagataacaaagaagaggaggacaatgaaatgactcttgatgagtatgagaaattattgaatgagaaaagaaaaacattggaagctttaaaaaatgcggaaagaaaggttattctggacagagattttgagaaaatgcagcttgttgataagaaaaatgatggcattttcatcaaactgaactcagaaaaggagagacaaagaaagaaggagacccttgaaaaagaggaaagagcccgtaagtctgtgagcataaatgagttcttgaaaccagctgacggtgagagatattttaccccatctggcactcgtgggcgtggccgtgggcgtggacgaggccgtggggacggtgttagcactagaggaggttttggagggaggtacagtgatgctgatcaggttgctgctccttgcattgaagg

SEQ ID NO: 465 - DNA, 364 bp, Pinus radiata
acacatgggcacaagaagaagaaaagagcccacgagccattgggggggagaaaggtgggaggggacttcgccagttcagcatgaaagtatgtcaaaaggtcgagagcaagggtcggaccacgtataatgaggttgcagatgaattagttgcagaatatgcaaatcctaacagtgcgctcatttctcctgatcagcaacaatatgatgagaaaaacataaggcggagggtgtatgatgcattgaatgtactgatggcaatggacatcatatcaaaggacaagaaggaaattcagtggaaggggttacctagcacaagtcctaatgaccttgaagacttgaaggcaaagcgcatgggattgcgggg

SEQ ID NO: 466 - DNA, 237 bp, Pinus radiata
gtcctatgaagctttacagaggagtcaggcagaggcactggggtaaatgggttgcggagattcgcctcccacgaaaccggacccgcctctggcttggcaccttcgacacagcagaagatgcagctctagcatatgatcacgaggcttacaaattgagaggtgagaatgctcgtctcaacttccctcatctgtttttaaacaagggatctaccagccctaaagcttgttcagttgcgg

SEQ ID NO: 467 - DNA, 578 bp, Pinus radiata
tctttctcgtgccgaattcggcaccagacagaaccaaccctaattttgatagacacagcagggtgtgatatggaggagaaaaaagatgacgaggacagcacaatgaatgaaggcgaggcaacagtgacactaatgcatgcaaaaaaacttctagaaagtggagttaatccctctgatattggcatcattacaccttatgcagcacaggttgggctgttaaagataatgagaagcaaagagatgaagttgaaagatttagaaatttctacagtcgatggctttcaaggccgagagaaagaggcgatagtcatatcaatggtccgttctaatgcaaaacacgaggtaggttttctaaatgaccgcaggcgaatgaatgtagctgtgacacgtgcacgtagacaatgttgtattatttgtgacactgaaacagtgagcagtgacaaattcctgaaacgccttgtagagtattttgaggagcatgcagagtatttgagtgcctcggaatatcttacttgattgtgacagcttgaaaatctgttgcctacaataacccatgatacactgagactacttttttt

SEQ ID NO: 468 - DNA, 432 bp, Pinus radiata
gcgctccttacggttctacgcatggtattcgagcttgcgacgcgcccactttcttgcgagctcattctgttcggcctcagaagggtctggccggccaagcttgagcttttgtatggctgaagctgttgccatgtttaacgtgataatgagaaaaatgctcagaccaagtgtcaggtagtacgagctcgtgccgaattcggcacgagctgggatacagtagaagtgccaagagatgtaaggagaagtgggaaaacatcaacaagtatttcaggaaggccaaagagagtaacaagaaacgtcctgagaatgccaagacctgcccttactttcaccagttggatgctttgtacaagaagagaaatctgggcaacaggcacaacaaaattatggtcctgagtattttctctgttgcttccactgggctgttcatgc

SEQ ID NO: 469 - DNA, 657 bp, Pinus radiata
gtttttccgcaggaagttttgatttgagtaggaaatcctttggcctcctggagctttgatttgctcaggaaaccctagcccttcggttcctgaagctttgcttttcgtaggaaaccctttggcaccggtaggcgatggctcccagcaacaacagaagagacgacaatggagcacgaggagttcacttcaggggcgtcaggaagaggccctggggtcgatacgcggcggagattagggatccatggaaaaaagttcgtctttggctcggcacctttgacacggccgaggaagccgcccgggcttatgacactgccgctatctccctcagaggtccgaaggcgaaaacgaattttgcatactcctcgccgtcctcctcatcatctctgcacaataatcagagcagtagccaaaacagcagcacggtggagtcctggccctctgcggcccctgtgactcgatccggagacctcgagcttcccgcttcttttctccctcgcctcggagtttccaccgggcggcgggttttaaatggtggaaacccccggtccgggcgccggcggagtctttcggagaaaaacagcggcagaaaagctgaaggcgccgaggcgcgaaccaccctaagcgattctgattcttcttcttctgcggttctagacg

SEQ ID NO: 470 - DNA, 581 bp, Pinus radiata
gtccagcaacagcagcagcagcatcagcagcatcagcaacaattactgcagcatcaacagcagcagcagatggcagatgctgctgctgcaatctatgcctcatctgtaaagaggcagggtaatgggacaatgatggggcagggtaatggaacaatgatggggcagggtaacggggcaatgatagggcagggtaatggggcaatgatagggcaaggtaatggggccattgatgggatcaccccttggaggaggacttggtctttcccctagaatgggtggagggattgggaatggcctacaaggaggattgggggtgggcttggcgggtctcggagctactgcgcttaccattggagcagcatctcccgccaaccagctttcttctgatggtatgggcaacagccatggagacaactcaacagtatcgccaattccttatgggttggacgtaagtgtaagaggcaggaaaagaggtggaccggtggagaaagtagttgaaagaaggcagagacgtatgataaagaatagagaatcggcagcaaggtcgcgagctagaaaacaggcatataccgtgaattgga

SEQ ID NO: 471 - DNA, 451 bp, Pinus radiata
ccaaaatggagattgagaaacaagaggaggatcctctggagattttctgcctccacccccgacaactaaatgctcagaggagctgcagaataagatcaccaaatatattgctttgaaaagtgctggaagaagcttcaacaaagaactacgcaattcaaagggatatcgtaatccagatttcttgcagcgtgctgtgaagtaccaggggatagatcaaattggtagctgcttcaaaaaggaaatatttgatccacatggatatgatccgagtgactattacgatgctttagctttggagctcaagagagaatttgaaagaagagaacaagagaagcaaaagaatcaaagggtagattttgttcatggagctgtacaaactacatcggtacagtcagtatcaaagccaattgtgcaggtcatgggtggtcaaaaggtgcctgttgttggggta

SEQ ID NO: 472 - DNA, 1286 bp, Pinus radiata
gacgttcctctttacttttacaacttgtaccgctggccatgaaaacagccggggagatctgaaattttccactaaagtttgtttttttgctggttctcgcttgggcctccataggacctagctggacacctcgaatctcctccggtcattttttgttttgacagggccggtttggtgattagggtttcagataacaggaggacaagtgttcgaattcgagagaagccagaatgagctctccgcagagcaataagtggctgtcatatttcgacgagccattgttggatgatgtaggcgtggggcagccggccaatccattcttctggtgcggtcagggcataaatgatcagcccgacgtaagtgtagaaattgatggccccaataaggacatggacgagcaagataaattatgtcctagaaagaggtcacgggaagaatctagtggtggacctgggtcaaaagcttgccgtgagaagatgcggagggacagacttaatgatagattcatggagctaagctctgtgttagaaccgggtaggcctcccaagacggcagacaaagccacaattttgtctgatgctgcacgtgttatgacccagctacgaactgaggcgcagaacctgaaagctgagaatgaacgactgcaggaagccattaaagatctgaaggcagagaaaaatgaacttcgtgatgaaaagctgagaatgaaagcagaaaaggaaaaattggaccaacaagtaaaagcaatggctttgcctacaggctttgtgccgcatcctgcagcatttcatgcggctgctgcttttgcagcccaaagtcaagcagcagcaaacaaaactatgcctgttccaggatatcctggaatggcaatgtggcaatggatgcctccagctgtggttgatacttcccaggatcacgtgctaaggcctcctgttgcttgaagcaggctcttattttatattccaaactggtgctactatttctttggccctcgaaacgaccttagtttctttggtatccaagttttagatgctaggtgccattgcatcagttcaatattctaattttttttatattgtgccatagagataattgaggataattacaattcatcctgatgatgaaatggattaactgctgtattatgaaaaattacactggagctttgcagaacaattattaatcctttgttcatggtcatgacatgtcttgaactggagatcgctcgaacacttacagttggtataaacatcttgacatttcgttcaaaaaaaaaaaaaaaaaaa

SEQ ID NO: 473 - DNA, 1358 bp, Pinus radiata
caaatttccaaaaccccagccccccacgtcaaagtgatgtgaagggacaaatcccttgaacaaattttcaaatgctatttatatatgaaatgacggtggagcgagagccacgggaagtagcgggtagaaggcaggggtataggctttttgggctgtgtctgtcgcttcgagacgacttctcattggagcgaaacgcctctcggcatttgggtcagtgaaccaacgaacgctggcttcaaggttttcgttttatctttcttatttcacttccttggatttagtttcctttcgatcctgaaaccgattcattgtgtgagttttccgcgaattaactgatcagggtttcggcctctgtatcaaatgttttggggagcttttctggtttgaaatgacgaggcccacatggcgaaatcactgttttccctaagctgaatgactacaacccatcttcagggcatctataactgtaaatttcgatacctgggtcgatccgtgtgcgaccctcgtccgagaaaagagagcacagcagcattggtaggtctcggtttcaatacacagctggggaagaatttcaaaataaaacgcaagcctcgggtttgggctccagaggcacacacgacaataatacatcataggagtagcggcgtaggtcgtgtgttcaaaccccatccagggaaaataccgtgaagctcgcttgtcgcaagttcgactgacatcgactgaattgcatttcttagtcggcaaaaatattaaagagtcaagacaaagagggggttacgggagcaggctgcgggttcgatcccaagataaggaaaaaagaaagaaaatttcatgaattgggcctgtaggttccagtcacaaaattaaaacctatcggtctcgtcttcgagctaaagttggggaaaaaactaagctctcagggaatgggttcccgcacaatgctgtcctctaatggtggccggacacctcagttccaaccactcgttcgtcagaattctttatacaatttaacgctggaggaggtccagaaccagctcggggacgccagcaagccgcttagcagcatgaacatggacgagctcctgaagaacatttggacacaagaagaaagccaggctatatccatggcgatcggcaatgggcccatgaacggtgttcctcccaactctgcccctgccagcggtggtttgcagcgtcaggggagccttacaattcccagaactctcagccgcaagactgtggacgaggtgtggagagatattcagcagagccagggaaagagtaacgaagagaagaagccgcagcagaggcaatccacctttggtgaaatgaccctggaggatttcttagtgaaagcc

SEQ ID NO: 474 - DNA, 517 bp, Pinus radiata
atatggcttcaggaaacgttgatccagatcaatgggaattcgcaaatgaagattttctccggggacaaaggaatttgttgaaaaatattcacagacgcaagcctatgcacagtcattctcagaatccccaacaaggcgtatgtaatgatgctataaaatatgaactggaggaggaaattcagaggctcaagagggataagggtctgctcatgatggagcttgttagaattaggcagcaacatcaaggtaccgagatgcatatgcagaccttggaggagcgtttgcaagccatggaacaccgccaacagcaaatgatggcatttctggccaaagctgtacagaagcctggatttgtggcacagcttgtgcaacagagtgaaaacaataagcttcttgaagcagctaataagaagagaagattacccaagcaagagaactgttcagaggctggggaaactgagttgacagacagtcagattgtgaagtatcaacctgcttcaggtgatgaatgtagtgc

SEQ ID NO: 475 - DNA, 337 bp, Pinus radiata
gttgctgctgcttctgcttctgcttctggtactgctgttgctgcgtctttgccagtgaacggtgctgctggggtcagatctagtgttgattcggagcattcggatatagaggcgtcttttaaagaggccgaatgcagtcaggccattgttgaaaggaggcctcggaaacggggcaggaagcctgccaatggtagagaagaacctctgaatcatgtagaagctgaaaggcagaggcgagagaagttgaaccagaggttttacgcactccgcgctgtggttcccaatgtgtccaagatggataaggcctctctgttgggtgatgccatttcttacatta

SEQ ID NO: 476 - DNA, 362 bp, Pinus radiata
caatatcatatcccaactcacgaaatagacaatctctttttatgatggtcaatgataaagaaaagtaatggtagattctcgtaaccaataaccttttaatagctgccaatgagtccaaattcattctgtcgatgcaatattgactgtatgcagaagaatcgagcactgtcacgcatctccaataccagcaaagtattcttgagaatgacttgaggtcgaaactgaaggataatctccaacagccacagaattctgggaagaagagacgctatagaggcgtaaggcaaagaccgtggggcaaatgggccgctgagattcgagatccaaaaaaagcagctcgagtatggctgggcacctttgac

SEQ ID NO: 477 - DNA, 612 bp, Pinus radiata
agaacatggccaagcacactgtctgcgcctcttttctcaacgaaggagacttcatttgccctccttacgaagatggaattggtctagaatggctgtcggacttcgtggaggattcctttgcagctacaggaagttcgaattctggttccttggctgacttgtctaaggacaaaatcgacgacaacagggagaagaagaagcagaacccaaccgatgaagcgataatccctgaaataccgcctataaaggagactcccaggtcacagagggcggtgcccgggcgggctcgcagcaagcggcgcagaagctcaggagccccaattcgcggttggtctacttctgaagattacgcattgcagaatgagggcggcatgaaaactgtaacaggagcggacgctataaatcattaccagtcctcggcgccccagcagcagccaaggcgctgcactcattgtctcagccagcgaaccccgcagtggcgattgggcccgttgggtcccaagaccctgtgcaatgcctgcggtgtgaggttcaagtctggcaggctcttccccgaatacaggcctgccaagagccccactttcattcgatacattcattcaaattcccata

SEQ ID NO: 478 - DNA, 680 bp, Pinus radiata
tggaaatgctgccaggcgtcctcatgatgtgcttttgaagttagaaaagttgagttcacagacaacgcttgaatcactacaaagactcatcgttcaaaagaaatgtctcctttttggcaaaaaggtaggaataagaattgacggaaagaagaccgcaaatacagaaaaagtgaatgaacggaacacaataccaaggatcatttttggggcattaacatttacaagaaaccgccctcatgcattatctaaaaatggaagcatagccgacacaagaagaaatatatgtggtgcacctcaagaggatggaaccatttgtacagctatccctcttaaaagcagaaaacggtgtcctgatcacaagggacaaaaaggccagaaagagaaaaatttatcaaaaattaacatcagtgcaaacgttgaatcaaggaaccaaggagttggggaacatgaaaatgaatatagatattgtggagtccttcttaaagatggatcaacatgcaagattatacccgataagggcagaaagcggtgtaatatccacaaggggatgcgcattcctggccaggcaaaataagcatttttatctggatcagaaagtgttaatgttccagaaatcagatgttagagtgcagaagagaaattacctactcctaaggaatgtaatcatactctaggttggc

SEQ ID NO: 479 - DNA, 544 bp, Pinus radiata
gttttatattttaagtggaaaatagcttggctggctagggtttcagtatataaaaccctggttgtttgaggggcgtaatacactcagttgatgttctagcgcatagatatatacacagactgtgagctttattctctgtgaacattctgggcaatgctactgagtctcagaccgcggaattaatacagatggcgctgaaggagaaactcctatcataaatatataaaaaggatttgtttttgacagtggaacagagccagttcaaagcaggcggcaatggcaacttccaatccgtttgatctgctcggcgatgacgacaatggcgatgtctcgcagctcgtcttcgtccctcaggagaagccgactgttaaaaaggcctctcagcctgctcaaacggcaacggccaagctcccgtccaaacccctacctccggctcaggctgtgagagagtcgagaaatggagtgggcagaggaggtcgaggcgggcgaggaggagaccgcaatcaagatgtgggctattagcaatcgtggccgtggcagcttc

SEQ ID NO: 480 - DNA, 971 bp, Pinus radiata
ggaagttctaggtcacacaccggagactcttgagaagtcttcagacaaggtgtggagaggtaaaggagtgcctggtgcgggacaggaacgcctctgcaagatgaatagggagaagcttatgaagatggctggtgctgttcgcactggtgggaagggtaccatgcgcagaaagaagaagacgattcacaggacaacaactacagatgacaagaaacttcaaagtactttgaaaaggataggagtgaatgcaatacctgctattgaagaggtcaatattttcctggaggattctgttattcattttcaaaatccaaaagttcaagcttcaattgctgctaatacgtgggtggtcagtggatctccacaaacaaagagacttcaagatcttcttccagggattatcaatcaacttgggccagacagttttgccaacctaaggaagcttgcacagcaatttcagaaagaagttcctcatcctgctgttgaagaagatgacgatgatgtgccagaacttgttgaaggagagacatttgaggaagcagctaagcaagaatccgctgcctaactgagttgagcttttataaacgattgacagttaagggagcactcaataatgtgttttgaatgtgatattagttataagtatattgtattttactgttaaagtaaaactatcaggggcatcttgttattatgatacagttcaaattttgtttttcctttccccttgtctcataaatttttcttcatgcaagtggattcctgtgaatgcaagattggtttgaattatgcaaattatagatttgtttttgacttcgattctgttatggtaaggtcttttcccccctccagtgtatggttaaaatgttgtagtacaaacaatgtccccaattagctgcttcttgcttggaattgtgcatgcgttgcaccttttggtattaaaatttttgcttgtctataaaaaaaaaaaa

SEQ ID NO: 481 - DNA, 710 bp, Pinus radiata
cttggagctgcctgctgaagtctttgatcgctgtaagtctgaggttgagattaatcaggggcttggcagatttggtatcaggtagaagctagagggtctctagtaatcgactctgcgcagtcccagagagaaatgaaaatgaatctcgaccttttgtagaagagtttcctatatctgaccccggatcgaggctatagcgaatgaggaaaatgagcggcccgagttcaatagcctgtttgccagagttgatagttccaaggatccgttggcgatgatttctattctccccgcgtagtcggtgaacttatcattgatcccatggagaacaaaacagatcaaatagtagccgggcagaaacgacgcagagatgaactgcagatgaccacactggcaacgcattgcttcaaggtggacgatattgcttgccagacttttcctgtttcatcctctgaaggtgaatgaacaataccctcaatcttgtatcgcattgttgatgttatgtagaagtaccaagcataaccatgccacaccaacaccagcaccaggaacgttttccttcacaagagggaattagctggaagagagatgatgaactcccacagccacagaatccaccaaaaaagaaacgttatagaggggtaaggcaaagaccgtggggaaaatgggccgcagagattcgtgatcctaagaaggcagctcgagtatggttg

SEQ ID NO: 482 - DNA, 1240 bp, Pinus radiata
attcccaggcctggttaaggagggcgggggttacatcagtgcaggtgggtttgatagaagcggcggagacggcttttgggagaggatattagctggccgctgtaaaaagttagtggtggttatggcttatgctgaaaatttgaggaattttggttttggggccaataatggtggttctaatcagagcaatagcagtaatgggggtgtagatggctattcttcgatgtccaatgagggagggcttgttatgggacagattggcggtccacatggctacccgaattcttcaccaagtgctcaagatgcgctatacgaggagctgtggcatgcctgtgctggacctcttgttacgctgcccaggatcggggagcgggtgttttatttcccacaaggtcatatggagcaggttgaagcatccacaaaccagggggctgatcagcacatgccattgtttaacctgccctataagatcctttgccgcgtaatcaatgttcaactgaaggctgaacctgatacagatgaagtgttttctcaaattaccttgctcccagaggcagagcaggatgagtcgtctgttgagaaggagcctctaaccccactgcctccaaagcctttagtatactctttctgtaagaccctcactgcatcagataccagtacccatggagggttttctgttctcaggagacatgctgatgaatgtcttccacctctggatatgagtcagcaacctccatctcaagatctggtggccaaggacttgcatggagttgaatggcggttccgacatatctttcgcggtcagccaaggaggcatttgcttaccactggctggagtgtctttgttagttctaaaagacttgtggcaggagatgcatttatctttttgaggggtgaaaatggtgaactgcgtgtgggagttaggcgtgccatgcgccagcaaaacaatgttccatcatctgttatatccagtcacagcatgcatcttggtgtcattgcaactgcatcacatgcagttacaacgaagaccatgtttagtgtctattataaaccaaggacaagcccatcagagttcataattccttatgatcaatatatggagtcaatgaaaatcaatttctcggttggaatgagattcaagatgaagtttgagggggaagaagtcccagagcaaagatttactggaaccattgttggaataagtgatgctgatcctgtgaactggccgaattcaaagtgg

SEQ ID NO: 483 - DNA, 516 bp, Pinus radiata
ttcagatctataaatcaatgtctgcattaatgacaaactaagttgaaattcccaaatgttggtggttactatttaggatcggacattaggcgttgtggtctcgggttcgattcacaaggcatttctgtttcggaatttcaaagcaacacgtatcagaaaactgattctatactgtgatgacgcaggctactaactacacagcaggtaccatcagagacgatcaagaggagcaatgtgtgaggaggggaccttggactgttgatgaggacatgagccttattcgatgcgtaaccacccggggtgaaggtcgatggaacacagtagccaaatttgcagggctaaagagaacaggaaagagctgcagattgagatggcttaattatcttcggcccgatgttaaacgtggaaacataacgccggaagagcagctattaatccttgaactccaccgtctctggggtaacagatggtccaagattgcacggcaactcccaggcaggactgacaacgaaatca

SEQ ID NO: 484 - DNA, 328 bp, Pinus radiata
ggggaatgattcctggccgaggccattcgagcgccatacacattgcggcggactgcgggaagtattgttttcagtaattcccttaattgggtcccagaatacgttctcagatccgaaaacggttcagtccatcggaggttacagcgattcgaaggcctgaaaaccctaaaaatacctatccccctttgtctttgaatggcggagaactatggcagcccggatagcagcccccggtcggagaacgaatccggcggcggtcacatgggcggcagcgatttctctgtgaaagagcaggatcggttcctgcctatagccaacgtggggcgca

SEQ ID NO: 485 - DNA, 919 bp, Pinus radiata
gtcatccatattttctttttcagtctgcaatacaaattgttattcgagatacgattgatcatgcttgaaggctatgcctatgcttgcggaaacataccgtgacagctttgagacgacttcgggaggtagcagcgtggatctggtaggaatggctctaccaggtttggcccctaatttgtcttctgcttcagtttcagcttcagcgtcggaagattctgccaagaaaataaggaaaccctataccatcaccaagtccagagagagctggtctgagcaagagcacgataaatttctcgaagcccttcaactatttgatcgtgattggaaaaagattgaagcttttgtaggatcaaagactgtcatacagattcggagtcatgcacaaaagtacttcttgaaggtccaaaagaatggcacaagagaacatgtaccacctcctcgtccaaaacgcaaagcatctcatccatacccacagaaggcctcaaaaaatgttcctgtgtcacagcaagtatcaactgcttttccaactgctgctactcaactagattctggatattatccaagggcagagtcgtcttccatactcaccaaatctggctcgtcatgcccaactgtttcttcctgggttcatcataccataccatcaatagatgcttcgtttgtggaaaaagatgatggtgggcctccaggcattgaaacagggaataattgcagtagtggtagcactgagagttctcctcctacgtggccaccctgttctgaaatccctgagaaagtcaaaccagatttttcacaagtttataagttcattggcagtgtctttgacccgagcacaactgatcacttgaagaagcttaaggaatggatccaattgatcttgaaactgtgttgtacccatgaggaacctttccacaacttg

SEQ ID NO: 486 - DNA, 359 bp, Pinus radiata
tctgtaagtgcttgagggcttcttgtatcgatgaggccattaacgatgggaagatcttttagttgttggagctgttcaaaagataatggccacgagcgtcttaatcgtggatcttggagtgctgaggaggatacaattttgagtgaacatatcaaaactcatggagttggtcgatggacatctcttcccaagaaagcaggtctaaaacgatctgggaagagttgcagattacgttggtttaactatcttcgttcagatatcaagcatggaaacatttctccggaagaagaggaactcctcatcagattacatcgtctccttggcaatcgttggtcgttgatagcaggacgacttccagg

SEQ ID NO: 487 - DNA, 438 bp, Pinus radiata
gtagggttttaaggaagaaagacgatccaagcagtgggtttttatcgagctcccacgcagtttgaagggtgtcgcagcagaagaagatcggattcgttcatcctcatcacaaagaatataccatgggggtcattacccatgtaaaagaaaagtaagagatggatcgggataagcttatgaagatggctggtgcagttcgtactggtggaaagggtacagtacgcagaaagaagaaagcagttcacagagccacaacaacagatgacaaaaggctccaaagtaccttgaagaggttaggagtgaatactattcctgctattgaagaagtaaatattttcaaggatgagatggtcattcattttataaacccaaaagttcaagcctctattaatgccaatacatgggtggtcagtggatctccccagacaaaaaatttac

SEQ ID NO: 488 - DNA, 478 bp, Pinus radiata
agaatttaggtagggttttaaggaagaaagacgatccaagcagtgggtttttatcgagctcccacgcagtttgaagggtgtcgcagcagaagaagatcggattcgttcatcctcatcacaaaagatggatcgggataagcttatgaagatggctggtgcagttcgtactggtggaaagggtacagtacgcagaaagaagaaagcagttcacagagccacaacaacagatgacaaaaggctccaaagtaccttgaagaggttaggagtgaatactattcctgctattgaagaagtaaatattttcaaggatgagatggtcattcattttataaacccaaaagttcaagcctctattaatgccaatacatgggtggtcagtggatctccccagacaaaaaatttacaagatctccttcccggaatcatcaatcagcttggacctgataatttgattaatttgaagaagattgcccaacag

SEQ ID NO: 489 - DNA, 608 bp, Pinus radiata
tgacgacgaagaagaagcttctctgaagggcaaggtgcggtggggactagattcgatagcggctctgggtttaaagttctgaattaaacgggctttggctaaaaagtaaaaaacggttggaatttgagcaggaggagctgatagagtgttattatcgggacggatgaaataattgaagccaaaggggcttatgtgtgtgttttgcggacttctgcgagtaaggggaaatggaattattggagtgaagtaggtgttcttggagaaatatgcgggcagctcataataacagcaataatagtgagaaatcttgcgtgttgagatctctctgagcttcgcttttcagaatgaggaccggcttctcccagcagcatcgggaaggggaaaagaggagtctcaattcagagctatggcatgcatgtgctgggccacttgtgtccctacctgctgttgggagccgtgttgtatattttcctcaaggtcacagtgagcaggtggctgcctcaacaaacaagaggttgatgctcacattcctaactatccaaatcttccaccacaattaatctgccactacacaatgttactctgcaggcagatgtggagacagatga

SEQ ID NO: 490 - DNA, 331 bp, Pinus radiata
ttgaattcttgtcttccccccagctgaggctctctgagaccaaggtgagattcagccagtagtaagctatagattgatagttcagagaaaagactgaaaggcaaaaactatatagacataacaacggagagagcagcacaggaaccaggttgcataatggctaggcctcaaagatacagaggagtccgtcagaggcactggggatcatgggtctctgaaatccgccatcccttattgaagaccagaatatggctaggaacatttgaaacagcagaggatgcagcacgagcatatgatgaagctgcaaggatgatgtgtgggccgagagcta

SEQ ID NO: 491 - DNA, 431 bp, Pinus radiata
ccgctatcctttccattacatcccacgttaggtcacggtttcgaacccttgcacggccattcttctgttaagatggtgagatctccctgctgcgacaaggttcataccaataacaaaggcgcctggaccaaagaagaagacgagcgtctcatagcacacattgaagcccacggcgagggctcatggcgttctcttcccaaggccgcagggctgctgcgatgtgggaagagctgcaggttgcgatggataaactacctgcgtcctgatctgaaacgcggaagcttttcagaagaagaagacgatctcatcatcaaactccactccctcctcggcaacaagtggtcgcttattgcagggagattgcagggcgaacggacaacgaaaataaaaaattactggaacacgcacatgaaaaggaaattgttgagcag

SEQ ID NO: 492 - DNA, 469 bp, Pinus radiata
gccagagctgtggctgttcccagaagaggatatcatcagctgtccagtttgtcctaagagactacagaagaagaatatagaagatgggtagatccccttgccccccaaaagaagcgcttaaccgtggggcttggacaggcatggaggatacgattctcaccgagtacattcgagttcatggcagtggtggctggaaagatatctccaaaagagcaggtcttaagaggtgtgcaaagagttgcagattgcgttggctgaactatcttcgtcccgatattaaacgtggtaacatttctcccgaggaagaagagctcattattcggttgcatcgccttcttggaaatcggtggtctctgatagcaggacgactgcctggtcgaacagacaacgaaatcaagaattactggaacactcatatgagcaagaagccatggctgtcaatggacgaatctcagtccaatacttcgca

SEQ ID NO: 493 - DNA, 380 bp, Pinus radiata
gaggaggaggacgaggaggaggctgggaaggagctggaggcgtgggagagagcatacgctgacgaaaggtcatgggaaaccttgcaggaggacgaggagggtcttctcaactttgacaagaaacagcagcaacagcaacagcgccaatacagacgccgtctgcagtctgctgcagccgcggcttcaaacattcagcgaggattgatccgttatctctacatcatcatcgacttctctcgggcggcagcagagaaggatttcaaaccaaatcgaatggtggtggttgcaaattgtgtcgaggcatttgtgagagaattctttgatcagaatccactaagtcagctgggtattgttattataaaaaatggcgttgcacatcg

SEQ ID NO: 494 - DNA, 420 bp, Pinus radiata
gtcgagctccttgctgcgagaaaacccatacaaacaaaggcgcctggagtaaagatgaagatgaagcactcgttgcatatattcaagcccatggagaaggcagttggcgttcccttcccaaggccgctgggttgcagcggtgtggcaaaagctgcaggcttagatggataaattatctccgtcctgacctcaaacggggcaatttcagcccagaagaagatgagatcattatcaaacttcattctatgttgggtaacaagtggtctttgatcgcaagcaaattgccagggcgaacagataatgagataaagaattactggaacactcacattaagagaaaaatgttagaaaggggtctagatccttctacccatctccctttaatgtcagaccatggctcttttgagtcctccagcaaga

SEQ ID NO: 495 - DNA, 568 bp, Pinus radiata
aaaagttgttcctccactggatttcactcagcagccacctgcccaggagctgactgccagggatcttcatgacaatgaatggaaatttcggcatatttttcggggtcagcctaagaggcatctgctcacaacaggatggagtgtttttgtcagtgcgaagagacttgcagctggtgattctgtgctctttatttggaatgagaaaggacaactgttgttgggaattagacgagcaaacaggccacaggctgtaatgccctcattggtactctcgagtgatagcatgcatatagggctccttgctgcggctgctcatgctgctgctacaaatagtcgatttactattttctataatccaagggcaagtccatctgaatttgtcatacctctggcaaagtatgttaaagcagtttatcatactcgtgtttctataggaatgcgttttagaatgctatttgagacagaagagtcgagtgttcgcagatatatgggcaccataactggcataagtgacttggatcaggttcgatggccaaattcacattggcgttctgttaaggttggttgg

SEQ ID NO: 496 - DNA, 396 bp, Pinus radiata
tgggagtttgctaatgattgtttccggaaaggagaaaagcagctgctctgcgaaattcatagaagaaaaagcgtccagcaatcttcagcagcccctgctagcagatgcgtttcgccggtcaattctgtggaagagcaggcattgtcttcgacctcctcccctgtttcttctcacgcagaggcggcgttagttaattgtggtcaaaatagcacatccgggctccatggtgaaaatgaaaaactcagaaaagataatttgcttctcatgtcagagctggcacaaatgaagaaacagtgcaacgatctcctcctgtttctgtcaaagtgtgtaaacattaccccggacaacctcagcaatatcctgatagccgcttctcaaacgaattgccgcgatgaa

SEQ ID NO: 497 - DNA, 643 bp, Pinus radiata
cggcaagtggggagtgccggacaatttgtatggagctcaggaagacagtggtggaagtagtgttaaacagaagaacttgaaggatggggaccaattcaccagtagtgatgaagctgacagtgaggtcaatgaattcaacattatgaaaagaagcaattcaggggttggatatgaagataacaaaagaagtggggggcaaggtgatggcaatcagtacaggtcacgtcactctcggagcatctccatggatagcattatgagtaagatgcataacttcagtgaagacttggaacaggaaccgtctcaaggtcggaatgtcagacactcccatagcaattcgatggatggaagtacaaatttcaatgtggaattcgggaatggggaattcagtgcatctgagatgaagaagatcatggccagtgagaaactggcagagcttgcaacggtggatccaaaacgtgtcaaaaggatattggctaatcgccagtcggctgcacgctccaaggaaagaaagatgcgctatatctcagagctggaacgcaaagtccagaccttgcaaactgaggcaacaactttgtccgcacagctgactcttttgcagagggatcaactggactgggcagtcagaaccacgagctcaagt

SEQ ID NO: 498 - DNA, 328 bp, Pinus radiata
aaaatctgtacctagagcccagcaatatccttcgcaatggctgacggccaccagttcaacaatattttgcttgtaggtcgaggcggcacgaatccgggtcaactgaggatacattctggaggtatagtgtggagaaggcagggtggaggcaaggtggttgatgtggcgaaaaacgaagtcaagagtttgagttggactcgagttcccaggggttatcaactcggtgtcaagcttaaagctgggttgaacatcaagcttgcgggatttcgtgaacaggatgtcggcaatttgacaaatttcatgacaaacacaataggattagctccca

SEQ ID NO: 499 - DNA, 372 bp, Pinus radiata
gttgtattgtattgcaagtgaggaaatttaggaggtgtggcgtaaaatgggagaccacagtggtggagagagcagtcctcattctgacatagagtctaccggcatccacaataatggatcttcttcttcctcacaatccatcatacgagagcaagaccggctgcttcccatagccaatgtggggcgcatcatgaagaaaaccctcccaaccaacgccaagatctccaaggaagccaaggaaatcatgcaagaatgcgtctccgagttcattagctttgttactggagaagcatccgacaagtgtcacaaggaaaagcgcaagaccatcaacggcgatgacatactatgggccatgaccactctcggattcga

SEQ ID NO: 500 - DNA, 344 bp, Pinus radiata
ccgcaacattcaacgtaatgaatatcataatcttttcaacttcatcagttccaagggattgaaaataatgaacttaggagatgcacatggcaccagtggagttgctgccgttctcgagaattcggatgatgaagctgtggatccacatcttgaacgtatcaaaagtgcacgtgaaggcggtgctggagaagatagtgatgaagaggcatgctacactggggacttatctctgatatgtgctgtagtcaaagaactaatatgcacacatgattaacaagagttaaatcaagagactgatgtctgtttctgttttgtttgtgtgcaggatgaggattttgttgcag

SEQ ID NO: 501 - DNA, 462 bp, Pinus radiata
gggaggcagagaaggaacggaaaaaggagtgaatttttgtgggtttgtgtttattgggaagatggggtgtgtgtcgtccaaggtggagaatgaagaattagtgaaaagatgcagggacaggaggaggctaatgaagcaggcagtgaattccaggcacaattttgctgcagcccacattgcttatttgagggctctgcaaaacacagggaatgctctggtacaatttgcggagggggaatccagtgctatgaatggcaatgctattgaagaagcggccacaccaatgccagcgaccccattaacagcatctcatcgccatcccatgaaattccatcctcctcctccgcctccgccgccgccattggtgcctagcagcccctccgtgagtcccagcatggagagctttcgtatgccatccaaacacaatcccctcagtaggtctacttcagacattagctatgt

SEQ ID NO: 502 - DNA, 504 bp, Pinus radiata
tatgtctctgcatttcagccagtccatggtttcaagttagttagtccaataaagcagagatgggtcgtgctccatgctgcacaaaagttggtctcaacaagggagcatggtctgccgaagaggatagtcttctgggaagatatattcaaactcatggtgaaggcaattggaggtctctgcccaagaaagcagggctgcgaagatgtggaaagagctgcagattgcgttggctaaactatcttcggccatgtatcaagcggggaaatattacaacagatgaagaagaacttattatcagaatgcatgctctcttgggcaaccgatggtcgataatagcagggagagtccccggccgaacagacaacgaaataaagaactactggaacactaacttgagcaagaaacttgctgtcaggggaatcgatcccaagactcataaaaaaatcacgacggacggcacgaacagagtcaacggtgatcgtttcagccagaggaaaggtgaga

SEQ ID NO: 503 - DNA, 416 bp, Pinus radiata
acggcaactcattcgtgaactagaacagatgtttaacattgaaggagaacttgaggatccaagcaaaggttggcaggttgtatacactgacaatgaaggggatatgatgcttgttggagatgatccatggcaagagttctgtagcattgtgcggaaaatttacatttatacgcgtgaagaggttgaaaaaatgaccccacaaaccccaagtgcgaactcaagggatgttcagaagagcctgtcacaagaggaaacttcccggagttctgatcgtcaagattcatcaattgcgggggtcaccgctgaaaggagttctgatgcctgataccatttcaatctgcatgttggtcacttctgtcgggcctgctaaaggggcatcaaagggcatgttttagttggccgtttgatgccttggg

SEQ ID NO: 504 - DNA, 1206 bp, Pinus radiata
gccgaaactcgaatcgatatgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggaggacgcgtcgctgcagaggcttgttcagaaatacgggccgaggaactggaccctgataagtaaaggaatcccggggcgatccgggaaatcgtgcaggctacggtggtgcaatcagctgagccctcaggtggagcacagaccttttaccccgtccgaggatgctgctattctgcaggcccacgcgcagcacggcaacaaatgggcaacaattgcccgagccctccccggccgcaccgacaacgcgatcaagaaccactggaactccacgctacggaggcgctgccgggaccccaaaaagggcatcgttgtccacctggacgacgaaatcagcagcttagacgccgctcgcaagcggagcagcgacggcttctcccacgatggcagcagtgcgctggaggacaacggatgtagcagctgggaagtggactccaagcggctgaagagactaggagaactgggaacagagcagggccccgaggttgaagccgaggtcgaggtttcggaccggagcgacgccaacccgggacgcgtgctgtacaggcccgtgccggtcgtgtcttttttcagttcattcgggaaaaccgttgcgaatctacaggaaacggcggccggcgcagtcggtgtcgatccgccgacctcgctgagcctgtcgctgcccggactcgatcccgcgatcccctctccgaagctgtccactcaaaaggactctcacaacaatagcacagttaataacaatattcctattccgccggtggtgaatacatgagagcagacgaggcggtggtggagcgactcagcaccgccgtcaaggccacggtggcaagcatgctaacgcctgttctgaactcgtcgccacgtggctacaacccaccggctgtgagcagcgaccttctggcgctgatgcgggatatggttgcgaaagaagtgcagaaatatatgtccagtcatcaccagc

SEQ ID NO: 505 - DNA, 386 bp, Pinus radiata
gagaatttggtcgttcatctgaaaaaggacgaggatatggaaggggccgtggccgtggtggtcgtggaggatatggtaatgatgctggtgatgaaagtcagaggcctcggaggcagtatgaacgtcggagtggtactggacgaggctacgaggttaagagagaaggggctggtcaaggaaattggggtactcctacagatcagggattcacagaggaacctgaagagctgagtcgtgcagaggaagagaagactgtgacccctgagaaacaggaagaacagaaacccagtgaagagtccaatcaagaaatccctgcaccagagtctgaagagaagaaagaggaggaagaagacaaggatatgactcttgatgagtatgagaaagtg

SEQ ID NO: 506 - DNA, 408 bp, Pinus radiata
ggcagtgaatagcagtctctctgttggaatgaggttcaagatgcgttttgaaggagaagagtctcctgaacggaggtttactggtacaattattggcatgggtgaggttgataatgtgagatggccagaatcaaagtggagatcacttaaggtccagtgggatgaaacatcagtggtcccgcgaccagagagggtttcaccatgggaaattgagacgtttgtagcttcatctgcagcacttaatcctttgccagcaccaaggactaagaagcctcggcccaatttggtgtcctcatctcaggaattaatgatacatggatcgggcaaaacagcaacagattcttcacaggtacacagattgccaagggtcttgcaaggtcaagaaatgaggacctttggaggatcctt

SEQ ID NO: 507 - DNA, 320 bp, Pinus radiata
gcaaagagttgcagattgcgttggctgaactatcttcgtcccgatattaaacgtggtaacatttctcccgaggaagaagagctcattattcggttgcatcgccttcttggaaatcggtatgtagagaatcgggggacatgatttattcatgcgccagaatttcacgattcctcatcgaattagtcatgcaatgtttgtgcaggtggtctctgatagcaggacgactgcctggtcgaacagacaacgaaatcaagaattactggaacactcatatgagcaagaagccatggctgtcaatggacgaatctcagtccaatact

SEQ ID NO: 508 - DNA, 395 bp, Pinus radiata
ccggtccgggcggtggagagcatcagccttggagttacagaccaggaaaatacaagatgggtagatctccttgctgctccaaagaggggctcaaccgcggggcctggaccaaaagggaggatatgattctctccgaatacgttcgaattcatggcgatggtggatggagaaatcttccggaaaaagcaggtcttaagagatgtggaaagagttgcagactacgctggttgaactatcttcgtcccgatattaaacgcggaaacatttgccccgccgaggaggagcttattattcggctgcatcgccttcttggcaatcggtggtcactgatagcaggacgactgcctggtcgaacagacaacgaaatcaagaactactggaacactcatctgagc

SEQ ID NO: 509 - DNA, 658 bp, Pinus radiata
gccatatctacatgaatctcgacatcttcatgcgatgaagagagcgagagggtgtggtggtcgctttctgaacaccaaaaagttagaggactcgaaagcaaatgtggataatggaaagacaccagaaggacatactgcgcaggctgggagttcttcaggttctgaagttctgcaatctgaaaatggaaatggaaattctacccaggagctacatggtgcttgtgggatgtcaggctcacaagttactagcattgcacagtcatctgaaaatggtacaacttatcaatattctcatactaatggagcatatcttaaccactatcaacatccacatttccatatatcagcttttcacccgctctcaagtggaggcgaggaaggcagcagtgcaaaaggtgggagcataatatctggtggatcacaacaacgagttgttgtgatccagtgaagtgtgaaataagatgttagtggtgagaatctcacgtgcttggttctccgtgtcacattgactataaagataggtctcaatgagtgcgaagatcataaaatgaaacagattttataaagtcttcgcaattttatggttcagaggccattatcagtaaaacaggcaacccgtgatggtttgtttttgaatgggttgcagtttgcacaaaca

SEQ ID NO: 510 - DNA, 351 bp, Pinus radiata
cacgagggccagagctgtggctgttcccagaagaggatatcatcagctgtccagtttgtcctaagagactacagaagaagaatatagaagatgggtagatccccttgccccccaaaagaagcgcttaaccgtggggcttggacaggcatggaggatacgattctcaccgagtacattcgagttcatggcagtggtggctggaaagctatctccaaaagagcaggtgagtgtcaataaaaatttaatagcaattctttttattagcagaaggaagtagcaatctcccaggttatatataacaattcatcagtcatatatatcagaaatttatagtcgagtctaagagggaga

SEQ ID NO: 511 - DNA, 754 bp, Pinus radiata
gttacacggcctgggaaattccgtagttgtcaagatggttatgctgtgagggcttccctcaaggctgaagatggagtgttatatcctcttgaaaaaagctttttcttcttgcctaaacccccgacacttattcttcacgaggagattgaatatcttgagtttgagagacatggagctgctggtacgagtagtatgtcttcacactattttgatcttattataaagctgaagagtgagcaagagcatcagttccgaaatattcagaggaatgaatatcacaatcttttcagcttcataaacaccaagggtttaaaaatcatcaatttaggagctacagaaactattggtggagttgcagcggctcttcagaattctgacgatgaagctgtagatccacatcttgagcgaataaaaatctacgtgatggtggagctggtgctgaagacagcgacgaagaggatgaagactttgttgcagaaaacgatgatgctggatctccaacagatgagtcagaagaagagggatcagatgcaagtgagagtgcagaggtcaagcaacctgcaaagaaagaagtaaagaaaaaaaaggcggtggctcccaaggcaaccgagaccaagaagaagaagaagggatgacgaggaagagggaggaaagaaaaagcagcggcgaaagaagaaggatccaaatgcgccaaagaaagccatgacttggttttgtccttttctcaagtgaaagagagatctgaaaaagagtg

SEQ ID NO: 512 - DNA, 424 bp, Pinus radiata
cttcctggtgttgttgctgtgatttctctgccattctgtgttgggtttatggttttagcttcactacaagcctttagcaagcctcacaaataagctttgcagtaggatgtctcctcccccgtcatattccatgtttcccaattcaggaatgggcttaaatccctcagtgacatcttcagaaccctctagtcaggtctccggatcgatcccccatcaatattcaggctccgaggaagaccctaaactgacgatcgatgaaagaaagcagaagagaatgctttctaacagagaatctgcaaggaggtccaggatgagaaagcaacagcatttggatgaattgagagcccgaacagctcatctcagagcagagaacagtcatatgctaacaaaattcaacattgcttcacagaaatacatgcagctg

SEQ ID NO: 513 - DNA, 487 bp, Pinus radiata
cgaggtcagccgagaaggcacttgttaacaacaggctggagtgtctttgttagcgcaaaaagactagttgcaggcgatgcatttatttttctgaggggtgaaaattcagaattgcgggtgggggtgaggcgagttatgagacagcaaagtaatatgccatcatcagtcatatctagtcacagcatgcatttaggtgtcattgctactgcatctcatgcagttacaactcggaccatgtttactgtttattataaaccaaggacaagccaatcagagttcattattccttatgataaatatatggaggctgtgaatagcaacctttcagttggaatgaggtttaagatgaggttcgagggtgaggaggccccagaaaggaggtttactggaactataattggaataggtgacgttgatccttccagatggccatcttcaaagtggagatctctgaaggtgcaatgggatgaaacctgtgcaattccac

SEQ ID NO: 514 - DNA, 648 bp, Pinus radiata
gttttcccgaaatatgggacgttcaaggtttccaacaaactgctatgttctctcagccctttctctttttcctgcggctcgagcgtgaggtcgatgtattcattcctgttaaattttcttttgttctcttttccattttcgatgcctctgtcgagttcttttttctgagatttttgcagtcttcgaaggtttgagtttggcctcagccttggaagtatctcttttggtcttaggtaatggaattgtaaccttcccgaacaacggcggtagtggtctggagattcgcatgtacgaagataaaatggcgcaatctgaggaacagcctaatgaagccacggttcctcgccctgctgattctcatagatctataccaacgccgtttctcatgaaaacctaccggcttgtcgacgatccgagcttgaacgacattatttcatggaacgaagacggcactacgttcatcgtttggcggcctgcggaattcgcccgtgatttgctgccgaattactttaaacacaacaatttctccagttttgtccggcagctgaatacatacggatttcgaaagattgtgccagacagatgggagttcgccaacgagttttttcgcagaggagaaaagaaattgctctgcgagattcatagaag

SEQ ID NO: 515 - DNA, 315 bp, Pinus radiata
tgcatttcagccagtccatggtttcaaggtcgaatctccttgctgacatgaatccatcaatatatatagagagagagaaatatacgtttttcagatttaagcatggccgtttaataatctgcattgcatggcgagattgtatttgtgttagaagttgattttctgttttttctctttcagttagttagtccaataaagcagagatgggtcgtgctccatgctgcacaaaagttggtctcaacaagggagcatggtctgccgaagaggatagtcttctgggaagatatattcaaactcatggtgaaggcaattgga

SEQ ID NO: 516 - DNA, 563 bp, Pinus radiata
gacacgtagtggatcaaagaattcggcacgagctcctgtctctgggttctctatgaattctaacatgggtgtgtctggaggtctagatgaaagtgggttttcacagcctccaccaaattttgcaaagatgaatgctcccacgagaacattcactaaggtttacaagctaggttctgttgggaggtcagtggatgtaacacgtttcaggggctatccagatctgcgtgccgagcttgaccgtatgtttggtctagaaggccagctggagaacccaagatcaagctggcagcttgtatttgttgacaaggagaaggatgttcttctccttggggatgatccttgggaggagtttgtcaataatgttcgatttattaagatactctctcctccagaagtgcagcagatgagtcaggaagatatggagttttggagttccattccaactcagcagcagacaagcagtagttcagacgactgtgtagctagaaattcttctcgcaacatcagatcagttctcacatcgcctggctccctggacgtattaagtgtagatccaattgtac

SEQ ID NO: 517 - DNA, 392 bp, Pinus radiata
ttcatgacaatgagtggaaatttcggcatatttatcggggtcagcccaagcggcatctgctgacaacaggatggagtgtatttgttagtgcaaagagactcagtgctggtgatgctgtgctttttattaggaatgagaaaggacagttattgctgggaatcaggcgagcaaaccgatcccaaacggttatgccatcatcagtgctgtccagtgatagcatgcacataggtgttcttgcggctgcagctcatgctgcttcaacaaactgccgcttcactattttctacaatccaagggcaagtccatcagaatttgtcataccattgtctaagtatgaaaaggcagtttatcacacacgagtttcaattggaatgcgcttccggatgctgttt

SEQ ID NO: 518 - DNA, 319 bp, Pinus radiata
tttaagcatttcattgagtcttaggtcacggtttccaatcctggcaggtctcattattctgtctctctggcaagatggggagaactccctgctgtgaaaaaggtcatacaaacaaaggcgcgtggaccaaagaagaggacgatcgcctcatcgctcacattcgagcccacggcgaaggccgctggcgttcgcttcccaaggccgcagggctgatgcgatgcgggaagagttgcaggctccgatggataaactacttgcgtccacatctcaagcgtggaaacttctcagaagaagaagatgagttcatcatcaaactcca

SEQ ID NO: 519 - DNA, 513 bp, Pinus radiata
accgtcgagagagcttcatatctaaccaatacataacacctgtatggcttcatagcttcacagcaacagggcaccatgggccgagctccttgctgggataaaatgggagtaaagaaaggcgcctggactctagacgaagataaaatactcgtcgattacattaccaaacatggccatggcaactggcgcgcactgcccaagcaagcagggctcctgcgatgtggaaagagttgtcgcctgcggtggacgaactacctgaaacccgacatcaaaagagggaattttagtccagaagaggaagatcaaattattaaattgcatgagctcatagggaatagatggtccactattgcttcgtacttgccaggaagaaccgacaatgagatcaagaacgtgtggaacacccatttaaagaaacgtctcgcgcgtatgaaagccgactcggttgcagtcgacgcacagccaacgcctgcgtcttccctggcctcatccactacagaaatgacgtgccac

SEQ ID NO: 520 - DNA, 219 bp, Pinus radiata
gtgcattgaagccaatggcggaggggctcctggacgctcgcttcccaaggccgcagggctgcagcgatgcgggaagagctgcaggctgcgatggataaattacctgcgtcccgatgatgtcaagcgtggaaatttcacagaagaagaagacgatcttataatcaaactgcactcactcctcggcaacaagtggtctctaattgcagggagattgccagg

SEQ ID NO: 521 - DNA, 392 bp, Pinus radiata
cttagcgacggttcccaatccctagtccctgcactttactcgtctctctgtgaagatgaggagattgcgctgtgagaagggtaatacaaacaaaggggcgtggacccaacaagaagatgcccgactcatcgcctacattcgagcccacggcgaaggcggctggcattcccttcccagggccgcaggtctgctgcgatgtgggaagagttgcaggctgcgatggataaattacctgcgtcctaatctgaagcgtggaaacttctctgaagaagaggacgatctcataatcaaactccacaacctcttgggcgataagtggtctcttatcgcgggtcgattgccgggccggatggaagaccagataaagaactattgggatacccactttaaga

SEQ ID NO: 522 - DNA, 447 bp, Pinus radiata
aggaaaggaggttcatattgctgagcctgaccaggtttcagatccaccaaaggcaatcaaatatgagccacctgcagtaagctgtgatcaggagaaacctttgcaaaagttatcaaaagaaactcaagtcaaacagcacggcaaccccaccaggagctgtactaaggtgcataagcaggggatagctcttggaagggccgttgaccttactaagtttgaaggttacgaggaattaatttgtgagcttgaacgcatgttcaacattgaaggagaactacggaatcctagcaaaggttggcaggttgtgtacacggataatgaaggagatatgatgcttgttggtgatgatccatggcaggagttctgtagcattgtgcgtaagattttcatctatacacgagaagaggttgagaaaatgactcctcaaaagcatgccaaactgcaagg

SEQ ID NO: 523 - DNA, 822 bp, Pinus radiata
tggaaacccaaagctccgataacaactacatggtcggctttgtcctggccaatgtcgtgggattgcagtactacacgggtaccatcaatggccgtgaaatgattcgactagttcgcgagcctgaaaatcggtacgaccccaacgccatcaaagttctcaacatgagcggccagcaggtcggtcacatcgagcgcgctgtggcgctggcactggcgtcccatgttgatcaatccctaattttaatcgaaggaatcgtgtccagggctctgcataaaggtgcttacaagttaccttgtcaaatctacattttcagtcacagggattcgatgggcatggtccttcagttgcttaaaggggccggattgaatgttattactgcggaggaccaagagtttttaacggcggaatccattgctgcaaaagaaatatatgaagatccaggggtgaaggaggttagaagggtcgatgatatctttgggtctcttaataatcccaagaagaggcagtcgatggaggcttgcgagcttgtaacttcgacactcttacagcaccagaaggaggcattggcttggatggtgcagagggagaattcttccgaacttccgccattttgggatgtttgtgacaagacgagtaagtcacagcagctcagatataaaaatgttttgacaaattttgagacgaatggaaggccgaagcctttgagaggtggaattttggcggatgatatggggcttggtaagacgctgtcattgctttcgctcattgcaacgaaccgtcccggtgccaagctccctcctgttgtagatattgctccctctt

SEQ ID NO: 524 - DNA, 390 bp, Pinus radiata
cttaattccgcaacacaatgcgttttcattggagttgagattttcagatcggcaattgccaagctcaacgcccccaaattgtgattcgatgtttccctcccactacacagcgttggcattgcgtcgccaaatgtggagaaaccccagagagtccggacagagccattcccagcctccagagaaagatagaggaaaaactttcggccaatttaagggaatccgaatgcgaaaatggggaaagtgggtgtccgaaattcggatgccgagatcgaaggagaggatctggctaggatcctataaaactgtcgagcaagccgcccgtgcttacgatgccgcactctattgcctcagaggaccaaacgccaaattcaatttccccaattccgtgcc

SEQ ID NO: 525 - DNA, 299 bp, Pinus radiata
cgagcaacagcgaagccgatttccaaagatggatagggagaaactcatgaagatggctggtgcagtccgcactggcggaaagggtacaatgcgaaggaaaaagaagacaattcataagactgccacggcagatgacaagagacttcaaagtaccttgaaaagaataggcgtgaataacatccctgctattgaagaagtcaatatttttaaggatgaccatgttattcattttgctaacccaaaggtccaggcttctattgctgccaacacatgggtgggtagtgggcatcgcaaacaaa

SEQ ID NO: 526 - DNA, 101 bp, Pinus radiata
gggaaagacccagatgaagttgaagcgagaacgcgaccagcaggcaagggacgcttcaaagcgccgcaacgggctgctgaagaaagcttacgagctctcgg

SEQ ID NO: 527 - DNA, 361 bp, Pinus radiata
atcgcttcggcccgagcaattttgcttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgccctgatctgaaacgaggaggtttttctgaagatgaagacgatcttattctcaaactgcacgccctcctcggaaataagtggtctctgatagcgggtcgtttgcctggtcgaactggccaccaaaatcaaaactact

SEQ ID NO: 528 - DNA, 337 bp, Pinus radiata
cgtaagagcaatgttcattcattttgcaaaactcttactgcttctgatactagcactcatggaggattttctgttttacgaaggcatgctgatgaatgtcttccacctctggacatgagtcagcaacctccttcgcaagagctggtagccagagatttgcatggaatggaatggcgattccgccatatatttagaggccaaccacggaggcatttgctaaccactgggtggagtgtttttgtcagctcaaagagactggtagcaggagatgctttcatattcttgaggggtgaaagtggagaactgcgtgttggagtgaggcgtgctatgcgtcaga

SEQ ID NO: 529 - DNA, 491 bp, Pinus radiata
agcactccgagaagcaattaaaaatggtgcttgtccaaactgcggagggtctacatcgctgggagagatgcctggattcgacgaacaccatttccgtatagagaatacgcgcttaaaggaggagcttgatcgagtgtctggcattgccacaaaatatataggaagatcaatgccgcatttggcacccatagcaacaccacctatgctcatgtcctctcttgaactcgcaatggggagcttcggtgggaagcagtcacagcctgccgcgccctcggtcgattttatttcaggtccactggctgacgggcctataattaattgtggaaccttgacggatttagataaaccgttggcactggaacttgcaatgaacggtgtggaggagttgatccggatggcacaaactgatgagcctctctggttgaaggatgttaatgcgggcagcgtgaaagagctttttgaacttggatgagtatggcagatcgtttcct

SEQ ID NO: 530 - DNA, 350 bp, Pinus radiata
ggtttctttatatttatgtgcagattgcctggacggacacttgccaatggacgtctcatatggctgtgccaggccaacgaagcggacagcaaagtcttcccacgtgctcttcttgctaagagcgcctctattcagactgttgtatgcatccctctcgcggacggtgtcttggagtttggaactactgaagtggagcgagaagaccctggtctagtccaacgcaccataagcttttttttggagtaccccaaaccgatatgttcagagcaatctacatccagcccacagtgctcagacagagacgaaaaggatcaagtgggcatggtcacaataatgtcctccgacagcat

SEQ ID NO: 531 - DNA, 437 bp, Pinus radiata
ttcctgttcgattcactggatgccgtgaacatcaacatggaggccgtgcacaagatcgagaagttcctgctagctccgaagatcgacgccaccatttcctccgccgccgctccgccatggaagaccctgttcgccgccgccggcttctccccagtggccttcagcaacttcaccgagacgcaggcagagtacctgatccagcgcctccatagccgcgggttcgaagtcgagaaagcgcacgcggctctcctcctcgggtggcagggccgcccactggtctccgccactgcctggaggtgcgggcccccgccttaattaattaaattatcaaaaaccaatttagcagactaataacagaaataaacaaaatctctgtttttccttttttcttgttaattttcccgggtattttctgttaaacctgagctttgaaaaac

SEQ ID NO: 532 - DNA, 508 bp, Pinus radiata
gaagaaaaacaactttccataagtggacggaactggggagaagtgaatctagaaggaaacatgctcacatttttggttggttcgaaaccagcttttgaggtatccttggcagatgtatctcaaacacagctccaaggaaagaatgacgttgtcctagaattccatgtggatgatacaactggagccaatgagaaagattctctgatggaactgagcttccacattccaaactccaatacaacatttgctggggatgaggcgagccctccagcacagatttttcgagagaaaatcatgtcaatggcagatgtggggtcatcgggtggagaagcagttgcattgtttgaggacattgctatccttactccaagaggtcgttacactattgagctccatctatctttcatgcggcttcaagggcaggccagtgattttaaaattcaatacagcagtgttcttcgcctttttgttcttccaaagtcacctcacacacttgtggtgatcaccc

SEQ ID NO: 533 - DNA, 374 bp, Pinus radiata
tctaggtcattcacagaattttagtactgatgtcaataggatgccggatgttccaccccggagaggaggccatcgcagggctcagtcggaaattgcgtttcgcttgccggacgatatcatgtttgatggtgatcttggttttgctggttttgacatgcccacggtctctgatgacgcaactgaggccgaagatctgatttccatgtacatggatatggagaaattaacttcttttggagagccgttgaattctgcggcgggagaaggatcgaagctcccctcgggtgctgagactaatcgacctccgcatcattcaagaagtctttctgtcgatgctgtattttctggattcgaaggtaacatggaagatacga

SEQ ID NO: 534 - DNA, 487 bp, Pinus radiata
acgatcttcaccctcggtgcgctctctgcttatcccgattcccagccaactgctattatattcggagtactgtacttccagaactggtatcttcaagcaccaagaccattttctgagctgttaaagatactatgagtgatatggatcgttcatcatcagaagattcagtggattctcaaggtgatgtgaatgcaaactacaagatggttttctcggaagatgaaaaggatctcataagcaggctgtacaatctactgggccagaggtgggctttgattgctgggcgaattcccggcagaactgcagaggaaatagagaaatattgtagcaggcgatatattagtgagtactaggtcacatgggtttctaatagtcaatgaagaagaagggtagaagcagccttgcctatctaactgatttaagtttgggatatatatatcgactttgagtgatggccatatcttctggggtttataaggaagtatgt

SEQ ID NO: 535 - DNA, 372 bp, Pinus radiata
tttgtttgtgaggtggagagatcagaattctgcgaggtttttttgtcaatcaaaaaacagatggacagggatcatcatttgcagcatcatcgagtcgtaattcaagcttttcaaatggatatgataacccacagaacacgaataagaattcttcttcggggggaactggtgatgccggaagctttgaatgcaacatctgccttgaacttgctcaggacccaattgtgacactctgtggtcacctgttctgctggccttgcctgtacaaatggcttcacggtcattcgaagtctcaagagtgccctgtatgtaaggctttggtggaagaggacaaaattgttcccttgtatgggcgtgggaaggtgggttctc

SEQ ID NO: 536 - DNA, 836 bp, Pinus radiata
gtttgttcgaacgatgaaaaccagctaaaacaaagcgcagggattggcaggattcgagcagtggtccttggggcggagttgatagaagaagaagaaacctaccatatacacatacatatattatatacatagacacatgggggctccgaagcagaaatggacttccgaagaggagggagctctcaaagcaggtgttgagaagtatggcactggcaagtggcggaccattcagaaggaccctgagtttggacactgcctcgccgctcgttccaatgtggatttgaaggataagtggcgcaatatgagtgtgagtgctagtggccaaggttcaagggataaggtaaagactccaagagtaaaagctattgcctctctgccttattcatcagttactgctgaatctacttctgtattctcaatagaagcaacaacctcaacaactccagataatcttatttcccctaaaagttcatcaaatgggaaaattcactcaccaaggtacgatggtatgattttagaagcccttacaagtatgcaagatccaaatgggatagacattgccacaattgcaagtttcatggaggagcgacatgaattgccccccaatttcaagagggcgcttggcacaaagctaaggcggttggttgcacaggaaaaggttataaagattcgcaatagttacaagctcaaagatatgacatctacagaagtgacatctgaagtcttgggatctgcaattccaattgataattcaatgcaatactctaatgcattcaccaatacaattgataccttttcagtagatagagtaaatgaagcttcaatggctgctgcca

SEQ ID NO: 537 - DNA, 478 bp, Pinus radiata
atcacagtcggcctctgatcaaagaagaagccgaatcaggtgataattctgcaaattctgcagatgtagaaactcttcttcctcaggttgatgaaacagcttctgctgatctgacagtgttcccaggttttgttaccccttatgtaccatacgggttccccatatggcacacttttagacccacaataactcaaacttccaatgtttataagccaacagctgtaatgccaactgctccaataaaaatggacgaatgcacagggttatcccagttaagcctcggcggtgttgcagcggcttctgcaatgaaaccctcagaactgtcactcaaattacatggaagacccccctctagacaatcagcttttcaggccaaaccatctctcaatgaaagcagtagtttgagttccagcagcaatgtcatcagtgtagtctgaattgcaaggaaaagcaggtgtgaagaagatgatggtatgga

SEQ ID NO: 538 - DNA, 565 bp, Pinus radiata
cacatccatacatgtggggtggacagccgttgatgccaccttatgggactccactaccatatcctgcaatgtatccacatggaggaatctatgcacatccttccatgcctccgggtgcacttccgtatggtcactatggaatgccatcacctggcaatgctgaagttacaacgactttagcacttccaaatgctgaagcagaagccaagtcctcggaaggcaaagagcggaatacaatgaagagatcaaaaggaagtttaggaagccttggaatgattactggcaaaggaggagaaggtggcaaggcaacatcgggatctgcaaatgaggccatgtcacaaagtggggacagtggcagtgacggttcaagcgaaggaagcgaggaatataacactcaaactgagtcacaagtggcgagaaagagaagttttgatcaaatgatagtagatggagccaatgctcagagtaccaatattcaatcatataattcccaggctggagaaccctatgtgacttccggcgggcatgcaatgggtaatcccattagtcaagctgttgctgcagt

SEQ ID NO: 539 - DNA, 350 bp, Pinus radiata
gggaaagtcaccgccagtgggaaggtaacttctggagttaatgatttattttgggaacagtttctaacagagactccgggctcagcaacagatacacaagaagctgagtcaaaaattcaggagactagaactaaggatcaagatgaaaggttgcctgagaatgggaagtgttggagcaacaagcagacattggatcaacttacagaacagatggggcagctggcatcagggacgcaaacttgaaataagattatagaggctgctagtaggtgcatatcactgtcagttctgctaaaatttctggttagcaatggtcactgtttatgtgtcctaatgaattgctccaaata

SEQ ID NO: 540 - DNA, 479 bp, Pinus radiata
catatcattcatatgaatatggatagcaggcaatcaggggaagaggaagactgcaacgtcactcggccaggaggaggaggaggaatatcattacatgttagcagcgtggaatattgccagaagagtgcttgtgttgcccatgatatctcttctgatgaacaagatctgataaatagacttcacaatcttctgggcgacaggtgggcactgattgcggggcgccttccatggagaagaagagaggagattgagaattactgtaaaatgagatacacagccactacctcttcttcacgctcttgaatctccctttctctcgccaggttatggagtgtggaccaactatcgtaatcagatagtttgggttgattcagattgtttaggtttatctccacttgaaaatatgtgtggatatttgtttgtttgttttatcaaaaccaagtatagaagaaataaaatttgatcgttttatcgattta

SEQ ID NO: 541 - DNA, 580 bp, Pinus radiata
agagagagaacgtgggagaaaacctgcaaatggccgtgaagaacctctgaatcatgttgaggctgagcggcaaaggcgtgagaaattgaaccagaaattttatgagcttcgtgccgtggttcctaatgtatcgaaaatggacaaagcttctctgctcggcgatgctgctgcttatatcaaagatctcttttccaaacagcaggatttggagtccgagagggttgatatgcaggttcaaattgacactataaagaaggaattattgatgaattctttgaagttggcagctaaagaagcaaaagatctttcaagcattgaccttaaaggttttagccaggggaaattccccggcttgaattcagaagttcgcattgttggccgagaggcgataataagaattcagtgtactaaacataatcatcctgttgcgagactgatgatagcactgcaagaacttgatttggaagttctccatgcaagtatttctactgtgaaggattccttaattatccagacagtcattgttaaaatgaccagaggtttgtacacggaagaccaacttcacgccctgctttgtaag

SEQ ID NO: 542 - DNA, 445 bp, Pinus radiata
caaaagcaaggagcaagaaaagcaaatggatttgcatcaaataatattgtaattggggcagtaatattgaagtccaagggaccaggggcttattaagggcatcgagtaaagcctctgaattttcaaccttgtagaacctaattgagtaaaacttcattcagttggattctcatcgttttcatggcttacaaccgcaaacatgccgccgccgcaaccagcccggacagcagcctgggctcagacaacgagtccggcggcggaggaggaggcggcggaggaaaagggcagtcgacgaagaatggcaatggcaactacattagagagcaggatcgcctgctccccatagcgaacgtggggcggataatgaaacgggcgctgccggggaatgcgaaaatctccaaagacgcgaaggagacggtgcaggaatgtgtgtcggagttcatca

SEQ ID NO: 543 - DNA, 682 bp, Pinus radiata
aattttttcctgtcaaagcactcgagaattggggtttgtggaagattgctattgaaagatctctgtgtgcaactctgaggtctgggatggtgaaggaaaccttcgcgttgttgaaagacaataacaacaacaatcatgacgaaatattgccttcgtcggtgaagcttcaagggcggcagacttatagcttgtaaaagttttgcctttagggttttgccattagtgttgcaagcctgtaaattataatttgcaggttccatggccacgcggaatccctttgacctgcttgaggatgatgataatggcgacccgtcgtcattgctggacaccctcgctgctgcaaaggacaagccggcggcagtggctgccaagaaacagcagccagcagtgtcggcgagcggaaaactgccgacgaaaccccttcccccggcccaggctgttaaggaatcgagggtttctccaaatgaggggggcaggggacgaggtggcggtcgaggcggccgtggatttggcaacagagaatcgcaggagtttggacgtggccgtgggggaggttataatgttgaacggaacttcaaccgcgagaacaatgcctattcgggttctcgtgttgggttctatgacaacaattctgatttgatccccagccgcaatgaggatggagatggagcttcgaacgatc

SEQ ID NO: 544 - DNA, 372 bp, Pinus radiata
gtttcctcaacctagtgagtaacattcgtgaattcgttatgcaagtagcttgcggaagggcacttctatcatgttattcttattccgagctactgtcagctatatgatggacctgtgttttcatcactggctcacttcacctgtttgagtatctgccatttttggatgtttgtgtaagcttggctaaataccagagacacaaagaaaccgtcctgtagccggagttatcgaaactatttacaatgccacgggtgaaattaatttccaggaacttcatggacatggtggcagcattaccggctgcaaagttagatcggctttatgataagtcattgcatttgcgaagcgggctgaggtctctgactcctgtgc

SEQ ID NO: 545 - DNA, 444 bp, Pinus radiata
accgagtactgagtttcgaagattttcataatacagcgagaatgaatttcaggcacttgaaaagtatcggaaaaggacgcaagcatagccctatgttgtttgtccgagtcaaatgaagcactgggattcgaatctttgatcacaaaatggcaaattatacctttaagcatgcaggcccagctcattattttcactctacgaattccgtttactatttcatgaaccgggcatttatgggctacaagcgacttttattataaggcttctttcttctctttgactttcatatagctgacatgaatggcagaagagatggacacaccgacaaaaacaacaaagacgcctacatcacaggaacaaacttccacaagcactcccgtggcttatcctgagtgggctgcaccaatacaggctctatataattctggaaagacaccactccct

SEQ ID NO: 546 - DNA, 570 bp, Pinus radiata
tcgttctcaagcaccagggagagcatggaaaggcgagatcagagtccggttgcagctcgccaccccatgagaaaacactacagaggagttcggcagaggcaatggggcaaatgggtagccgagattcgcctccctcagaatcgaacccggctctggctcggcacctttgacaccgcagaagcagcagctctagcatatgaccgagctgcttacagatggcggggtgagtgcgctcggcttaatttcccccatttgttctcaaaaaagtatcagaattcctctcccagctccaccaatggcaggattcctcgcctttcttgtgaaaaatctgatcagaaatatgcatataatggtgacccagttcatacgaatgtatataagggtcccccaattcggataactgcatacaacggcgacccagttcctatagatgtatataggagtgacccagttcgggtaagtgcatatactggtgacccagttcggataagtgcttatagtggtgatccagttggcaataccgttactttagcggaatccgagcttgaaagctcctgcagccatgaatcc

SEQ ID NO: 547 - DNA, 532 bp, Pinus radiata
cttgattatatggaagaacaaaattgggatataaatggagcaaaatatgatggttcagaaaagtggaaagctcatagtagtgaacaaaaggatcttggtacaataccaacaaaggtggaaggaaggattggcaatagagagaatagtttagatgtcacacgtggtggggctctttgggacatttttcggagagaggacataccaaagttacaggattatttattaaagcactgtcaagacttcagacatagcagaaatgtatctgttgattcggttgtccaccccattcatgatcaaactttttacttgaatgaaggtcataaaaagaaattgaaggaggaataccaagtagaaccatggacatttgaacaacaccttggtgaggcagtttttattccagctggatgtcctcatcaagttagaaacttgaagtcctgtataaaagtggctttgaactttgtttcacctgaaaatttacaagaatgcattcgtttagaggatgagttgcgcttgcttccaaagaatcacaggg

SEQ ID NO: 548 - DNA, 447 bp, Pinus radiata
agggtccccgcgaaatgactgaagaggagcgggagacgaagaaggccgccagtgtggccgccacggctgccgaccaggagctcaggaagaaagtgctgcgggatctgcacgcgctgattaatcccaacgcgactggagaggcggatccggcggagtttccaggggatgatgctactgtagatggggaagtcacggacgccgagtggttttacttggtgtccatgatgaagtcatttggaaatggcttgggggtgccgggacaggcattttgcggtggcatgcctatttggatcattgggtcagaaaagcttcagagctacaactgtgagcgggctcgtcaggctcagcaattcggcattcaaaccatggtatgtattccaacacctaatggagttgttgagttgggttccacggatttaaatccgcagaactgggatttgatacaga

SEQ ID NO: 549 - DNA, 1163 bp, Pinus radiata
gtggtctaagagctgatagtttgtttttaagtggtggttttttctggatatttttcctgaatattagcggtttctattcctgcggaaggcagcagcagctggtttgaaagcagcagcagctgttttggaaacaaaacaatgtgtggaggtgccattatcaaggaattcattccggccaatcgatctcggcgtgtaactgctagggagctgtggccggatttcgacacgttcgctgaattcatcaatggcggagcaacgcaagaaacattcaataaacctggcaagttggacgagggatgcaagcagaagagtaagcccagcaagggttctgtcaagacccagcaggaattttgttccgggtttgaaggtgggagaagtgaggtgattcctcctttggaagatgtggaagggtccacacccacgattggggggaggaagagaaaaaatgtttacagaggtatcagacagcgtccatggggaaaatgggctgcggagattcgagatcccagtaagggggttagggtttggcttggaacgttcaacacggcagaggaggccgccaaggcctatgatgcagcggctaaaaggatccgaggtaagaaagctaagctaaattttgctgataactcgtgttctgttaaaaatgacactagcaagaaattgtcaggaaagaaaggaaagttgtgctcaaaacaccctgctttgttgttagagggtttcaatgcaagctgtaaggtaaaaccctcatattcagcaaatcctgatttattagggggttacaatataaacaggaaagtaaaagcctctttgagtggtgtcggcaaatctgatcttacaatctgtggatacgatgatatggaatatggtgactctgggttctcaaaacccagtgccccattccaaaacaattcaaatgcatgcacggtccaattttctgagcatagcaatttaacccaaacttcgcagaaatcgtgctcttgtgagatctgtagtcacaattactcagagatgagcaatgtaatgcctcctgcttatggcaatgctgtaaattttgaaccagtgcaaacttccaatccaggaggttattttgattctgaccatagcagcatgtcatttgaaggggcgcatttcccatgggctcaagaaataaagacgccagaagt

SEQ ID NO: 550 - DNA, 545 bp, Pinus radiata
cagctaaaactcttcatccctgctgggatgcataccagcttgaggacgaaagagcaagtgctgtttatataaatgtattttcgggggatgctacaactgaatttcccagtgcattgcaactgggcagaggagggattttggcagatgccatggggcttggtaagactgtcatgacaatatcactactgcttgcaaattctggcaaaggtggctttagtggtatggatactgtggagccctttagtgcgaacagctgtagtgaaaaaacaatcattcatccttataatataggtgtagagctgggaccatcacagtacaccaacaaaacacaaggcacaagtatgctaaggagatcaagcagtgggttacataaaggaggcgggaatcttatagtatgtcctatgacattattaagtcaatggaagacagaacttgagacccatgtacagtctggaaccatgtccgtgtatgttcattatggacaaagtagaacaaaggatgttaaaagtcttttgcagcatgatgttgtcttgaccacttatggg

SEQ ID NO: 551 - DNA, 353 bp, Pinus radiata
gcactacaagtctatacctcctccatctcatgttataaataccagttggcttctttctggtctctttgcattattgattggctggctgttttctctcttctggacctcgatcttcggtcttcatcgatatcataatctctacctctatctccatcggggcttcgttgcctctgtatgtttgtaggtatgatgtccgaagttggcagcccaacaagccaggacagccgcaactctgaggatggagaaagggagaactgtgctgtgagagagcaagataggttcatgcccattgctaatgtcattaggataatgaggaaagttctacccacccatgcaaagatttctgatgatgc

SEQ ID NO: 552 - DNA, 448 bp, Pinus radiata
caaacaatccgtgttttgggagcggagagcaacggggaggggtctttcatgggttttgagcagacgagaggaggaggaggaggtgcgaagatgacgcagcatcaggtggtaactacggagttggtacggcaggcaactgagcgcttacgaaagctttgcaggacgggagtcaaagtcgaactcagagatttttttcaactctgcatcgtgctcgccaagtcaattgattctgcggttgtatataaccaaattccgactatggtgcatgagttgccacaattagtgagacaggtttttgaacgcaaagatgatattcgacttcaaccagcaatcatggttcttatgctctctgtgaagaatgcttgtcgaagtggttggtttcgtgtcacggacacagatgaactgctaaccatgtcaaaggagctgtcaagtcgctttacgagtacgg

SEQ ID NO: 553 - DNA, 883 bp, Pinus radiata
tttttattcaaatgacagcacgacttcccttcctcagatgtttcccaggctgcactcatcagctgcagcaccacgcggttttggattctccctgttctttgttctgttgcgttaaagattggttgcaggtcgaatcgcccaggccgatttgaattctcctgaggattgacaagatgacgcgcaagtgctcgcactgtggcaacaacgggcataactccaggacgtgccctaaccgcggcggggtgaagctcttcggcgttcggcttaccgatggcccgatcagaaagagcgctagtatggggaatttgatgatgatgtccaaccctagctctcccgctgacccctccgagccggcctctgccgctgctgctgccgcggcggcggcggccagtggctatctctctgatggtcttgttgaagcctccacttcctccaattctcgcgagcggaagaaaggtgtgccatggacagaggaggaacatagaatgtttttgctaggtttgcagaagcttggcaaaggtgattggagaggaatagcacggaattttgtcataacacgaacacctacacaggtagccagccatgcacagaaatattttattcgacagagcaatatgactagaaagaagagacgttccagtctgtttgacatgacgccggtgagttttttcttcctgtcttaaattcttggtgtggtgggcatggaagggattcaggaggcgtcttgggcaaagatcccaaaaattggatttgcaatcaatcatgattcataattgttctgaaaattatgctaagaactaatctcatctttcaaacctcaaatggtattcttttgtttgaagttgtttctaagtttctttaatgtctattcataatttcattt

SEQ ID NO: 554 - DNA, 310 bp, Pinus radiata
gtgagttctaggcatgagtttgcagtatcgcaaatggcctacttacaagctttgaggaatgctggcgcaacccttagacaatttgcagaattagaatcaatggagcttcagaagacttcaccttacccacatcttcgccattatcgggtcaccttgcccccttcacctcctcctcttcccccacctccaccacctcctcctccattgtctctcaccccttctcctagttatggatctgcaacttttccttccagcatcccagtcaatcgaagcatctacagatgtccgtatcagcaatgctcaccatcat

SEQ ID NO: 555 - DNA, 463 bp, Pinus radiata
gtcaacttccagatgaagctattgctcttgcagcagcatcccatattgagagggagctgcagataacatcatggaatctgagctgcaattttgttgcctctactttgcagggtcgtgaatgtattgagcgcctggagattacagggattggagatccatcaggacggggacttggttttagttatcttcgagttgctccaaagccaccaatatcgagtgctttggttaaaaaaaaggcagctgctgcacgtggtggttccgcagttactggtactgatgctgatctccgaaggttgagtatggatgcagcaagggaggtgttgctgaagtttaatgttgacgaggaacaaattgaaaagatgactaggtggcatcggattgcaatggtgagaaagctttcaagtgagcaagctgcttcaggcgttaaagtagatgcaacagcattgaataagtttgcacgggg

SEQ ID NO: 556 - DNA, 496 bp, Pinus radiata
agatgagtggagtgagttcggctcggagctgtgtcgaggttttgttgggcagaggctgctctgtggagcggatcgctcgccgtttgagtcgggtcgcaaacgggcaatttgcgatgtggaatgtgcagaactgtggaagtagggttaatggaagacaattgtgcttctgatgatcgggagcatatagctttaatcgattatacgtttgctctttgttagttcattgggttatagttgtttcagtggagtagcgtgcagcagtttgatcggcgaaaatgaagagtccttcaaccagctgcctttctcatccagtggagggggagcagaagagcataaattctgaactctggcatgcttgcgctggaccccttgtttccttgccctcagtgggtagtgttgtgtattattttccacaaggccacagtgaacaggttgcagcttctactcagaaggtagctgacacgcacattccaaattatcctaatcttccttatca

SEQ ID NO: 557 - DNA, 642 bp, Pinus radiata
cctcaaggtacaatgggatgaaatatcagcaattgcacgaccagagagagtttccccgtggaaattagaaccttcattaactccagtggcagtgaatcctctgccagtagccaggggcaagaggcctcggccaaatatattaccttcatcttccgatttatcagtgcatgacaaggccccagtggattctactcaggtgcacaggtttccaagggtcttgcaaggtcaagaagttatgaccttggggggatctttgggtgacggtgagttggagagtggtcaaaagatggttgcatggggcggatcaaaactggatgatgtcaaagcagaaggtatgggttgtcaaagaaggttggtttcagaaaattggatgccgccacttaggcatgactcactatattcagatactttctcaagttttcaacctgtgggggaagtgcaagaattccgtggttcattaacaaatagtatcctggaagatggccagcagccaaagctttcaagaaaacagtttcaggaccaagagggtaaaattgtggatggatcaggactgtggtcaatgagttttccaaacagcttacaattgtgcgagtcaaataggaagatgtctgcgacctctgctgcccaatcgcacaagcagag

SEQ ID NO: 558 - DNA, 653 bp, Pinus radiata
ggaattgacaagtgatagtcacaggcaagcaacacttcagttggaagctgaagttacagcgtggcacatcagtttctgtagcttgataaaaagtcaacaggattatatttgtgccctgtatgagtgggcacgtctaagtcttgttcagcttgggaatgaagcacagtgggaacgaggaaaccgcccacctatttatactctttgtgatgtatggcaacaagtacttaaaagattgccagacaaggttgcttctgagtccatcaaaagcttcatctctgttgttcatgctatagtgatgcagcaagctgatgaacaaaagcgcaagaagaaagcagaaaacatttctagagagctgcaaaagaaaatgattgctttgcgcaatattgaaaagaagtattatagttcgtattcaatacctgctagggcagatgctacaacagagtctcaatttgaattgggtcacacagatcctttggcagaaaaaagagcagagattgaaatatataaaaggcggttagaagacgaaaaggccaactattcaaaatccgccagaggaaccagagaaatgaccttaaataatattcaaacaggccttccaggtctattccaagcactgagtagtttttcaagtgtgtgtgcaagttcctttgagg

SEQ ID NO: 559 - DNA, 100 bp, Pinus radiata
atggctatgggggaggcggagcggatcacggggccatggagtcccgaggaggacacatcgctgcacaagctggtggagaaatctgggccacggaactggt

SEQ ID NO: 560 - DNA, 385 bp, Pinus radiata
gttggcgccctgcaaaattcgccagaaatttattgccgaattacttcaagcccaacaatttctcaagttttggtcgccaactaaatacatatgggtttcggaagattgtaccagacagatgggagttctcaaatgagttttttcgcaagggagaaaagcagctactttctgaaatacacagaagaaaaggtctaatacaacctcctccaccacctgagaacagatccatttcaccgtctaactctggtgatgagcaaacgtggtcttccacctcctctcctaactcttccacgggggtggatgcccttagccataagaatgcaattgaagaaaatgagaaactgagaaaggaaaatctgttattggtatctgagctgacacaaat

SEQ ID NO: 561 - DNA, 328 bp, Pinus radiata
cccacatggactgcagcaccattcctccgatgatgctaatggcgatggcgataagagaattggggtggagacaggcagctctgtatgtccagagctctggcatgcctgtgctggccctctcatatctctgcctcctaagggcagtcgtgttgtgtactttccccagggtcacctggagcagattgcagacaatgagcttcacaggggtggccgtggctccttcctcaacatcaaccatgcggctgcaccgatggcagaggaagcatcttctgcagcagccttgaatataccgccatcgttcataagtcagccgtgaaccaacagatgc

SEQ ID NO: 562 - DNA, 440 bp, Pinus radiata
aggaaacgctcacgctcttaaagattagatcagaaatggattctaagttccgcgaagccacccacaaaggtcccttatgggacgaagtctcaagggctcttgcggagcacggttaccagagaagttccaagaagtgccgggagaaattcgagaatctttacaaatactacaagaaaacaaaagaaggcaaagcaggaaggcaagacggaaagcattaccgtttctttagccagctcgaagctttgtacggaggaacaactattgatgctgccgacagttgttttggcgtaacaacacggacaaatttaaccgaaagtccaggcctggactttaacggagacggagcctcgcagaaatacgctgacactcaccacaacagcgagggctttagtttgtcttcggattcttcttcggatgacgagtacagtcacgatatacag

SEQ ID NO: 563 - DNA, 359 bp, Pinus radiata
ggaaagtcgaacatagaaatcttctgtgcattcatagaataaatattctacaggctgcactgtaatttaggcgagaaatcgaataaaatatacatttgtttgtttacgatggagttggcagatgagcattccatcctccgctataagaaacccaagctctccaagaatgtcgtttccgagcgccgccgaaggcagaaaatgaacaagcttctctacactctgagggctctggttcccaatatttccaagatggacaaggcatcgattttagcggacgccatcgaatatgtggagaagctgaagcaacaggtggagagagctgagtctgacgttcaatccaccaacgtctcggctctatc

SEQ ID NO: 564 - DNA, 249 bp, Pinus radiata
agggaattcaacatcaatgctgatgtctatgcacaggattccattgagttgttgaagcagagtgggattgatttcgagaagaatgaggagaagggtatcgattcgcatcgtttcggcgagcttctcatgtcatcgggcgttgtgttgaacgaaaatgtgaattggattaccttccacagtggatatgactttgggtacctgttgaaattgctgacatgccagaacctgccccccgaggaatcggatttc

SEQ ID NO: 565 - DNA, 542 bp, Pinus radiata
agaaggttggaatggcttagtccgctcatttgatggcgaacagatctttgtggggaggttcagactttgattatgagaacgaagccgatacgaggaagggtccatggactgtggaagaggacatgcagcttggtattgtaaatttgcacggagaaggacgctggaactttctcgccagagcatctggcctccagagaactggtaagagctgccggctaaggtgggttaactatctccggcctgatctcaagcggagcaagatcactcctgaagaagaacgtttgattattgaactccatcgccgttggggaaataggtggtctcgtattgcacaaagtttaccgggaaggacggacaatgaaatcaagaatttctggagaactcgtatgaagggaaaactaaactcagaaactcagaaggacatcgccggcgtggatgcagacgacggagtacagtttgaaagcgaattgggatcttgccgcctcccagttatttcatcccatgcactgcctgaagtagacgttgcagagccttcgagtact

SEQ ID NO: 566 - DNA, 358 bp, Pinus radiata
gggacagtagggaggaagagaagacgaattcatcgatccagtattggtgtaactggtggcagaggactacggcatttcagcatgaaagtttgtaagaaagtggagagcaagggctggacaacatacaacgaggttgcatctgaattagtggccgaatttgtgaatccaaacagcacacatctttcacaagatcagcaacagtttgatgagaagaacattaggaggagggtgtatgatgcactgaacgtactgatggccatggacataatatcaaaggagaaaaaggagattagatggaaagggctacctacaacaaatctaagtgacattgaacggctaaagactgagcgaaagaggt

SEQ ID NO: 567 - DNA, 722 bp, Pinus radiata
atgcccccgagcatttgccagggcttacaacttgaagacgcacatggccactcatgaccccaaccgtcttaaacctcatgtgtgccctcaccgctcgtgtgcgcggtcatttagccgcaagcatgacctcgggcgtcacttggtcagcattcatcgtgacgattccgtggtttctacgccctctgcgtcaatgaagtctattggtgtcgacagtggccgcaggagttggtgtgacaactgcggcaaaggaacaatcggcgcatcgtgccagtgttcatgcgccgatatcaagtagttgcggatcgcgttgctctgtttaaacactatgcgtatatgccatgggcgagtatatttcgccactcgcttcgtcgcagtcgatggttgattcgtccactgcgttcttctgacgtatcattcctctatctgcgctatttccgacgtgttgcgtatcgtaccgttcagccatagatgctgaacccagtgacgaacgcgatcgcgagttgcctcatttattcgtgacccaccacgggctggacactatttgtctaactatctcgctgggatactttatctgttgttaactccttattcaacgattcttatgagcccttcgtaacttagcagatcccattttccttaacttttcattatattttggaaggcgcatcggcgtgattccaccaatactggaaataccattatttatgcatccaaaaaaaaaa

SEQ ID NO: 568 - DNA, 489 bp, Pinus radiata
ccacgctccaattttctgtagagtcgcgaggaatttccaactgagggttattctgaaggaaaacaggcgccgggagacatttgatgggttcttgagagaggaccacgagaaagtatcccaactggtcactcagcactacaaggtccagctcgagaccaaggaaatcagcgtcaagggatggaactggggatctactgatgttcaaggcaacgatctcgcatttgtcgttgcaaacaggaccgcctttgaagttcctctccgatcaatcaccaactcgaacatcgctggaaggacagaagtctctctggagtttagcacggcgcccgccccatcagctagcaaatccaaaaagggccgcccagacgaattgacagaaattcgattctatgtccctggcacgcataccaaggacgatgacgacgaggctgatatcaccaaagatgacgaggaggtttctgcggctcaggcgttccatgacatgatcaagga

SEQ ID NO: 569 - DNA, 490 bp, Pinus radiata
ggttctggtggcgtgaaaatggaggatcattctcctgtcatcatcaactctcagtcaggttattgccagtcccagcagtcatcacagatgcctttagctggctacatgtcacctcatggtattcccattcagcacactgacgatgccgcctcgaaagagactcagtaccttcgccggaggtgcttcaattgccacaccactgagccaccgagttggaggagatcgacactcacccccgggaagattgtttgcaacaagtgtggtctttatgagcgcactcatttgcgacctcgtcctcttcgttttgatgaactgagagcaggcaacaagtcgcgaaagcaaacaaagtcaagtcccaagggcgcaaaggtcatccccccggggccccttcctatcaagaaggagcctgctgagatggaggcgatctcgcggaggatgtctgtttcatccagctcttccgcccaatccggtggtggtgggtcgagtgact

SEQ ID NO: 570 - DNA, 447 bp, Pinus radiata
aagaaacctacttggggcaagagctcagcccatgaaactttctgctaaaaatgattcaaaactgggtattgcaaggcctgccaagctctacagaggagtgagacagaggcactgggggaaatgggtagcagagatcagattacctaggaatagaaccaggctctggcttggaacttttgacacagcagaagaagcagcgtttgcatatgacacagcagcctaccaactacgtggtgagtacgcaaggcttaattttccggacttgaggtatcttttgctctcaaattcggataacggtagccataatgttctttcgccaccgggtaatgcgttatctgtgctgaaatcttctgttgatgcaaagctccaggcaatttgccagcgtttatcccaggaaaattcttcagaaaatcgtctgatggcacacagtgccaacaatgaagctct

SEQ ID NO: 571 - DNA, 146 bp, Pinus radiata
cgtttctggaagccctagaaaagagagaagaggatagaatgatgagggaagaggcctggaaaaggcaggaaatggcgagattgaacaaggatcaagaattaaggtctcaggaacgttctatggctgcttcaagggatttggcatta

SEQ ID NO: 572 - DNA, 767 bp, Pinus radiata
gtcgccctgtcaaataatcccttgatcttcagcgctaaggttgaaaatggtactcctagctatgatggtctgaagcatgctaatacgaatcctatgccattttctgggttgggtaatgtttccatgggccctttgttttatcaagcaaatccaatccagcgagtcaagagagttagggacactagtttcatcatgggacccccttccagccctttcggtcgcatgggtgtgaatggtcacatggggatgaatgatgtcagtaagagcttgcagcctggttttaaggccagagttccttaccccctccaagctgctagatcggattcattcgttgctcaaggctgctttccctatgaccctaatctcagcagcactagtaatttgcccctgggagggttttcatcaggcagccatgccgttatgaatggtactttctcttcttctaggcttttttctggccagaagctggagctcccttcaagccaatttgctgagtctgtgcagactgcaggctcaagcatcaatccagttttaaataggagcactcctcttttgctgccgcccgttcctactcagacgatcaatcaagtagactacagcttctctacgccaaaaaatagtgggttgttagaatctatgttccaagaagctcaaacaatgggtggggttaaggctcattcctcctcaaattcctcgattgacctgcaggggggctccaaaagcagtatcagtaacccactgaacaatgggttcctatgcagatcaag

SEQ ID NO: 573 - DNA, 445 bp, Pinus radiata
gaatcaggatggaggagcctctgcaaattataaattcatctccgatacagcagcagcatgatcatgatgatgatgatcatgggcatgggcatgaggaggaggtaattccccaccctctgcttccccctcctggcgacacttgtattgttccatacatcatgcccgtttccacctctaccgcagaaaaacaccctccccagccaaccaatatcgcctttaacggcccggaaacagaggaagacgacaagaaacgggatagagagcacaagaagcggtccaagaactggaccagggtcgaaaccctcaagcttataaagcttcgaacagaatttgagcccaggttttctcgcagcggaagaaagacggaactctgggacgaaatagctgagtctctgcgaaaagaacagtttttcagggacgcccagcagtgcagagacaaatggga

SEQ ID NO: 574 - DNA, 731 bp, Pinus radiata
cccaggtgtcaggaatatacaggaccctcggaaaaatggtgaattgggctgaacaaagagatcagaattgaggtgagaagagcaggcaatctctgatcagaagaattgggtacttggaatcgatggatcagcagcagcccacaataccagcactacctcaagtgggttatggcacaaatccatatatagcccctccgattgggggtcctccacacccacaattagcatcataccatcaacagcttcaggccttctggggtaaccagatgagggaggttgagcaggcgcaggacttcaagacccacagcctgcctctggccagaattaagaagatcatgaaggcagacgaggatgtgaagatgatctctgcagaggcaccggtggtgtttgccaaggcatgcgagatgttcatactggaactgaccttgaggtcatggattcatacagaggagaacaagagaagaactttgcagaagaatgacatagctgcagccattggtaggaccgatatatttgatttccttgttgatattgtgcctagagatgaattcaaggatgaggggttggtgatccctagggctgcgggtgccgtgcccttcatgggtcctggggataacgtgccatcttattactatgttgcacagcaagctcccaacgtggcggcttatgctcctcctactcagcaaatgaggtccaaagcacccgcacctcctcctcatggcagcagttga

SEQ ID NO: 575 - DNA, 441 bp, Pinus radiata
cagggatcattgactctgcccaggactctaagtaggaggactgtcgacgatgtgtggagagagattcataaggaaaacattgatgggaatgggaatgcgccggcgaatcaggccaggcagccaactttcggagagatgacattggaagatttcttggtgaaagcaggggttgtgagagaggatgcagagcagggagatgggcagtcatttggggcgtttcggaatgctctagatggggaatttgtagcaaatttggcagaaagaaatggggataatagattaggtatcggtaattcacttggccttggatttggtgaaagagggcataggaatggagaagtgggtagtaacaagagtggagcagggggcgtgcctggactttctctgtctcctactaatgtcttcctaatcatgctgccatggatatggtgaatcttgatg

SEQ ID NO: 576 - DNA, 271 bp, Pinus radiata
tttcaaaggagaaaaaagaaatccattggaaggggttgcctaaagacaagtataaatgatgttgaacagcttaaggctgagaaattgctcttgaaaagtaggattgagaagaaagcatcttattttcacgaactcgaagaacagattataggccttcaaaatctggtgaaacgaaacgagcatagatatagttcagggaatactccatctgggggtgtatcgttacccttcatattggtccagactcatccccgtgccactgttgaaattg

SEQ ID NO: 577 - DNA, 315 bp, Pinus radiata
gggattcgcagagctaccagacagaaaagtggtattctatcttcagttctttctaaccagaatgcccatctcagtgtgcttgctgctgcagctagtgctgttgccacaaagagcatgtttcatgttttctacaatccaaggacaagtccagcagagttcattataccttatcagaaatatgtgaaaagttgcaagcaaccattgtctattggaatgcgcttcaaaatgagatttgaaacagaggataccgctgagagaaggtacactggcatgataactgcaataggtgatgcagatcctgctagatggcctggt

SEQ ID NO: 578 - DNA, 384 bp, Pinus radiata
caagatacccactctgaaccaatggctatggagatgggattagtcattgacggagataggttttcctcagagggtgatggagatattatgttggatggcgaggatctgttgccagaaatcaacgatatgttttgggaacaatttcttgcagagagtgcaacgtcagggggaacggaagaggctgagtctgcagcgcaggaaagtcttaccaaagatcaggatgagaaaccatctgaaaatgggaattggtggaaaaaaaatcaaaatatggataatctcacggaacagatgggtcagctggcatcagaatcaaatccttgagatttgtatcttgggatagatgcatattgtggagggaaggatttcctttcccaatttggctag

SEQ ID NO: 579 - DNA, 434 bp, Pinus radiata
gcgatggagctgttagggatgcagggaggctagtgcctgccccttttctggtgaagatgtatcgtttagtggatgatccctccacaaaccacatcgtttcttggggagagaataacaacagcttcgtggtatggcgccccaaagagttctctgcgtctgtgctgccatgctatttcaaccacgccaatttctccagctttgttcgacagctcaataattatggatttcgaaagacatttcgcgggcagtgcgagttttcgaacaaattattcgagaagggcaagcagtatctcctttgtcatatccatagaagaagagcgtccaatagctcgcccatgccgatggaatatggtaaatcatctttattattcccaatcattctacctacacaacactccaatgttctggcagcgcctctgccttcttctctgtca

SEQ ID NO: 580 - DNA, 322 bp, Pinus radiata
aaggaacggatcttaaccgaagagaacctttttcttcgtaaaaagtgtggtgatgaacatgtggattgttcggcttttagaacacctccagcacaacttagaagcatccagaacattgatgtggagactcaactggttataagacctccaactgtacaacagcaccctgacgtcgatagtcctcgataactgttgcatatgcaaattttctactttcatgaaataaacaaacagtacacctcattttgttcgccttttgtaaacgtataattactactgcatatgtaagctttcctctcaaaaaaaaaaaaaaaaaaaaaaa

SEQ ID NO: 581 - DNA, 448 bp, Pinus radiata
aggatccaaatgcgccaaagaaagccatgactggatttatgttcttttctcaagttgaaagagagaatctgaaaaagagtgacccaggaatggcatttactgatgtgggaagaacacttggagaacggtggaaaaaaatgtcagctgaggagaaagctccttacgaatcaaaagccagggctgataaggaaaggtacaaggaagcaatggccgattacaaaagtggtccaacaaatgtggactccgggaatgaatctgatagtgaatagagcatcatacttacaagttcatattaacatggctagccgtgtaaagtaattgctttcatttaaatgctttcaccctctggtgcaatctttttacattcacttgagaatattgttggtgtacttcacattagcaaaaagcaagcttacaactgagtagtgtcgagggatatacctacatg

SEQ ID NO: 582 - DNA, 321 bp, Pinus radiata
accttctttttggagtcaacatagattcctcgtctttgattgttcctaatacagtatcaaacatgaggagtattggcagcagtactgatgcagtcatgcaatttggtgtttctaattatttgaatgcacctccttgtgcttccggttccaatatttcattgaattcagacatcagtgcttctgcatgtttagatgaaagtggacttttaccacccgctgaaaatttgggacagatgaatgcacctacaagaaccttcataaaggtttataagcaagggtcagtcgggagatcgctagatatctcacgcttcagcagttatc

SEQ ID NO: 583 - DNA, 739 bp, Pinus radiata
ctgaattctatccggttgggtattaaattaaggtgattgttcgctacagacgttctgtggacaccgagtgagtctcctagccttggaatttggcaccatctcgtcccgcagccatttcagttcgatctcccgccgtcacaaaaaataatccccaattctccagctgtccctgccgtgtctgcacgcgacaggtctgcccgggctttggtctgtggaatttcatgccaatttatcacctataaactccacccgcatctgcccacaaaccccacaagtcacacccctcttcgtcttctttgaaatctcagatgggttctgccaattagctcggatccttgcctcttcagttggttttgtgagcacacacgaggccaggacccgggtatcaacgattcccctcaactgacgtaacccatggcgaccactcggcatcagcgcagtcccgatagcagcccgcgctcggaggatgaatcaggagcgcacacgtacagcaaccaggatggttccgtgaaggaacaggatcgatttctgcccattgctaatgtgagcagaatcatgaagaaagcccttccagctaatgccaagatatcgaaagatgccaaggagacggtgcaggaatgcgtttcagagttcatcagtttcatcactggggaagcctctgacaagtgtcagagggagaagaagaagaccatcaatggggacgacctgctgtgggcaatgggaactctagggtttgaaa

SEQ ID NO: 584 - DNA, 413 bp, Pinus radiata
aaatctgactatcgggatagtgatgatgaaggaggaggtactgttcgagaaggaaaggatctgcaaacctcaaatttcatcgattattttggtcaaagtaatcatacagaagaagcagaaaatgagcatgatgcatcagtggataccaaagggcccctggaatccagcaatgaagtcggccatcctaccacataccccgaatcttcttcattgtcagcgcaaggctctgagcctcgagttttttcctgtaattactgccagagaaaattctacagctcgcaggccttaggaggccatcagaatgctcacaagcgagaacgcaccttggcaaagagggggcaaagaattggggcttttcaacacaggtacataagcatggcatccctgcctctccatggctctacagaatcagc

SEQ ID NO: 585 - DNA, 622 bp, Pinus radiata
ggtctaggggaaaagctttgaaattatttgggtttgagtttagagggtcagaaggtggatcatttgaagggactaatggttctgatcagccacaagatgggactaatatattaactgcaggtgaagcatccactgagccagtggaggaagaactagtgattgaggccaaaaatggagattcagggaaattagaagatgtgggtagtccagtagaggctggagaaagtggtagcactagcaattgcctgggatcatctgctcaagaaaatcggaaatatgaatgccaatactgttgcagagagtttgcaaattcgcaggctctcgggggccatcaaaatgcgcacaaaaaagagagacagcaggccaaacgcgcgcacctgctggccaccaggagcgctgctgcgagtgccaacagaagtggcgccactgcatggtgcgggaacataaacggtaacctctaccatagaaatttccttttcaataattcctacttcacacgcatgcaggtgtttcaagaagatttcccgacctttcagaccccacaggctgttgcagctccatcaatcccgcattatatcttcagttaccagcagcagcagcaggcgcccgtgcagagtcgctg

SEQ ID NO: 586 - DNA, 349 bp, Pinus radiata
tgtaccggaaaattccaaacaaataatcaaccatggactcatattgccggagatgggctcagtggacagcgggcgcgaaggcacgagagcaattttgtccgatgattgtgtgaaattcgaatgccgatattgttgtagggttttcccgacgtctcaggctctcggcggccaccagaacgcccataaacgagaacggcgccgggcaatgacgaggtttcagagatcgccctctgacagttcaaactattcaggaaaacagaatagtattgatctgtttagccgtgagagagttcccgggtcttctctcctttcaccacacggtacgagggatcatgttgtttgcagtgac

SEQ ID NO: 587 - DNA, 368 bp, Pinus radiata
aaaaaggcgtcagaatggggtgagtctgtagtaagtacaagcgaaaacagtaatgacttggatcctcctacttattctgaaacctcttcccctgctcaaggatctgatcctcgggttttcccctgtaatttctgtcaaagcaaattctacagttctcaagcattaggaggtcatcaaaatgcccataagcgtgagagaactttggctagaagggcacagagaatggggtcttttgcacaaagatattcaagcatggcatcacttccactccacggttcctcggaaacaagttggacgcccagtcggtttttagggataaaagcacattctttgattcacaaacctttccctgaaggtgataacctgcc

SEQ ID NO: 588 - DNA, 516 bp, Pinus radiata; identical to SEQ ID NO: 483

SEQ ID NO: 589 - DNA, 340 bp, Pinus radiata
gagaactagtctcgagttagttatttgattcatattggttgcagaggattttcagagattgatgatgagtgctgaagctgctatggagagggagagttgtttcatggatgaaatgcgcaggccgcagaggaagaagaagaccgacgcagaggatgattttgacgagtgttattatactcatatgtgcaagatttgcaagaagaagttcgtctcagggcgggcttttggcggtcatatgagaattcatggccctgtggccactgccgccgccgccgctgctgagagcaatgggaaaaatctggagccgcagaggaagagatcccgtgctgaagagattcga

SEQ ID NO: 590 - DNA, 391 bp, Pinus radiata
gttgggtgtaaagggtctgacgcgtttgaggagagcttgaagcatttttgtagagtttgcaagaggagatttgcttgtgggagggctctgggtggtcatatgagagtacatggagctgaattgggtgcaattaagggtggtggtttggaagagcagtttgagaaggggagggtgaaggagcccagtaggagttgtggtgattctgtcaaggaaggagtgcaggatgaggtagagggcttgaattctatgtacactttgaggaggaacccgaagcgaagctggaggtttgcagatcaggattactcttttgcctttgggggagtagatgggtctggggctaagagatttgggtctacatttttgagggattcaagagtctgtgaggagtgtg

SEQ ID NO: 591 - DNA, 260 bp, Pinus radiata; identical to SEQ ID NO: 349

SEQ ID NO: 592 - protein, 94 aa, Eucalyptus grandis
MGERDDLGLSLSLSFPQGHLHQQQQQQQQQSLQLNLMPSLVPSSASSAQSGFNLQKRSCNDAFPSSSDRNSEARSFLRGIDVNREPSAGAAADY

SEQ ID NO: 593 - protein, 44 aa, Eucalyptus grandis
DKARLVQETGLQLKQINNWFINQRKRNWHSNPSTSTVLKSKRKR

SEQ ID NO: 594 - protein, 291 aa, Eucalyptus grandis
GEPLWIRSVETGREILNYDEYVKEFKVEAPSEGRPKRSIEASRETGVVFVDLPRLVQSFMDVNQWKEMFPCMISKAATVDVVCSGEGPNRNGAVQLMFAELQMLTPMVPTREVYFIRYCKQLSAEQWALVDVSIEKVEDNIDASLVKCRKRPSGCIIEDKSNGHCKVIWVEHLECQKTTVHPMYRTIVNSGLAFGARHWMTTLQVQCERLVFFMATNVPTKDSNGVATLAGRKSILRLAQRLTQSFCQAIGASSYHSWTKVPTKTGEDIRVASRKNLNDPGEPLGVILCAV

SEQ ID NO: 595 - protein, 25 aa, Eucalyptus grandis
MQAVMTGCDSSNIAALPSGFSILPD

SEQ ID NO: 596 - protein, 263 aa, Eucalyptus grandis
QNGPSMPPVQPFVRAEMLPSGYLVRPCEGGGSIIRIVDHLDLEPWSVPEVLRPLYESSTMLAQKTTMAALRQLRQIAQEVSQPNVSGWGRRPAALRALSQRLSRGFNEALNGFTDEGWSIMGNDGIDDVTILVNSSPDKLMGLNLSFSNGFPAVSNAVLCARASMLLQNVPPAVLLRFLREHRSEWADNSIDAYSAAAVKVGSCALPGSRIGSFGGQVILPLAHTIEHEEFLEVIKLEGMGHSPEDALMPRDIFFLQMCSGVD

SEQ ID NO: 597 - protein, 134 aa, Eucalyptus grandis
CPIDSGRSFDTSLSLGLGCYGDPEDHEIKIKKPLAKLSGNSTCLTIGLPGGEACGLGSASGDEVRNIPSRSASSFSNSSSAKREKAEQGEEEAVERGTGSPRATINIEDEDEFSPRKKLRLSKAQSSILEEMLQ

SEQ ID NO: 598 - protein, 220 aa, Eucalyptus grandis
MGQQSLIYSFVARGTVILADYTEFTGNFTSVAFQCLQKLPATNNKFTYSCDGHTFNFLVDDGFTYCVVAVESVGRQVPIAFLERVKDDFTKRYGGGKAATAVAKSLNKEFGSKLKEQMQYCVDHPEEISKLAKVKAQVSEVKGVMMENIEKVLDRGEKIELLVDKTENLRSQAQDFRQQGTQIRRKMWLQNMKIKLIVLGILIALILIIVLSICGNGKCK

SEQ ID NO: 599 - protein, 149 aa, Eucalyptus grandis
EEKKEEPPAPITVVLKVGMHCEACTRVLRKRIRKIKGVETVETDVVNDRVIVKGVVDPPKLVAYVKKRTGKQASIVKEEEKKEEEKKEEAKKEESKEGEKKDGEEGKDEDGSKMDIKKNEYWPSRPYMEYQMYPTQIFSDENPNACSVM

SEQ ID NO: 600 - protein, 107 aa, Eucalyptus grandis
MEFPSEFSEASSQKRIGGRGKIEIKRIENTTNRQVTFCKRRNGLLKKAYELSVLCDAEVALIVFSSRGRLYEYANNSVRGTIERYKKASSDSSHPQSVSEVNTQFYP

SEQ ID NO: 601 - protein, 233 aa, Eucalyptus grandis
MARGKIQIKLIENTTNRQVTYSKRRNGLFKKANELTVLGDPKVSIIMISSTGKLHEYISPSTSTKKMYDQYQQALEVDLWSSHYEKMQENLRKLKEVNKKLQLEVRRRFGEGLNGMSLSELCGLEQDMDNAVSLIRERKYKTLGNQIDTARKKKKNAEEINKSLLQDWTNLIKHLREDDPHFGMVDNGRDYEAVIGYTDAAAAARLYTLRLQPDQPNLTSGGGSEITTYPLLE

SEQ ID NO: 602 - protein, 113 aa, Eucalyptus grandis
MSQKGLIYSFVAKGTVVLAEHTQFSGNFSTIAVQCLQKLPSNSSKYTYSCDGHTFNFLTDSGFVFLVVADESVGRSVPFVFLERVKDDFMQHYSASIASGDPHPLADDDEDDD

SEQ ID NO: 603 - protein, 111 aa, Eucalyptus grandis
MGRGRVELKRIENKINRQVTFSKRRNGLLKKAYELSVLCDVEVALLIFSSRGKLYEFGSAGPSGINKTLERYQRDNFTPQDNVAEHETQQNWFQEISKLKAKYELFNKLQK

SEQ ID NO: 604 - protein, 65 aa, Eucalyptus grandis
LLQKSSQEEDKARLVQDTGLQLTQINNWFINQRKRNWHSNPSSSTVPKSKRKRSHAGDPDKERPM

SEQ ID NO: 605 - protein, 60 aa, Eucalyptus grandis
CIETKARFGKSVESPATDKWKVWFQNRRARTKLKQTAVECEMLQKCCETLKEAHSRLQKE

SEQ ID NO: 606 - protein, 188 aa, Eucalyptus grandis
MAFAGTTQKCMACEKTVYLVDKLTADNRIYHKACFRCHHCKGTLKLGNYNSFEGVLYCRPHFDQLFKRTGSLEKSFEGTPKIAKPEKPVDGERPAATKASSMFGGTRDKCVGCKSTVYPTEKVTVNGTPYHKSCFKCTHGGCVISPSNYVAHEGKLYCRHHHTQLIKEKGNLSQLEGDHERETMAPES

SEQ ID NO: 607 - protein, 66 aa, Eucalyptus grandis
FGKIFEESVRKELSPEFAKLMQEGSAYLPSGICMSTMGRHVSYEQAIAWKVLSAEENTVHCLASLS

SEQ ID NO: 608 - protein, 60 aa, Eucalyptus grandis
DGNIEKVLDRGEKIELLVDKTVNLRSQAQDFRQQGPKMRRKMWLQNMKIEADLVLGIIIA

SEQ ID NO: 609 - protein, 133 aa, Eucalyptus grandis
AQRERERENGFAGTTQKCMACEKTVYLVDKLTADNSIYHKACFRCHHCNGTLKLGNYNSFEGVLYCRPHFDQLFKRTGSLEKSFEGTPKIAKPEKPVAGERPAGPKPPVCSGDRETQCVDVRARFPTEKVTVL

SEQ ID NO: 610 - protein, 162 aa, Eucalyptus grandis
MAKEKIKIKKIDNLTARQVTFSKRRRGLIKKAEELSVLCDADVSLIVFSATGKLYDFSSSRQMKGEDLEGLNVEELDQLEKKLEAGLSLVIKNKEEKTWNEINKLQRKEAQLIKQNKQLKHEMKMILHQEKSVTVNSESVKDVYISRNSMPPLDGDSPNPSS

SEQ ID NO: 611 - protein, 43 aa, Eucalyptus grandis
MMAVTSACKDKMGIDNGKYVRYTPEQVEALERLYHECPKPSSL

SEQ ID NO: 612 - protein, 226 aa, Eucalyptus grandis
SAASLKASPFGYPGMRPTRFTGSQIIMPLGHTIEHEEMLEVIRLEGHSLAQEDAFVSRDIHLLQICSGIDENAVGVCSELIFAPIDEMFPDDAPLLPSGFRIIPLDSKSSDVQDSLTTNRTLDLTSSLEVGPASTNCVGDVAPSHGARSVLTIAFQFPFDANTQDNVAVMARQYVRSVISSVQRVAMVISPSGLGPSINPKLSQGSPEALTLANWICQSYRHVLII

SEQ ID NO: 613 - protein, 82 aa, Eucalyptus grandis
RDHWSSFSAPIDEMFPDDAPLLPSGFRIIPLDSKSSDVQDSLTTNRTLDLTSSLEVGPASTNCVGDVAPSHGARSVLTIAFQ

SEQ ID NO: 614 - protein, 234 aa, Eucalyptus grandis
LDLASSLEIGPAGNRSFNDINANSGCTRSVMTIAFEFAFESHMQEHVASMARQYVRSIISSVQRVALALSPSNLGSHAGLRTPLGTPEAQTLARWICHSYRCYLGVDLLKSSNEGSELILKNLWHHSDAIMCCSLKALPVFTFANQAGLDMLETTLVALQDITLEKIFDDHGRKTLCSEFPQIMQQGFACLQGGICLSSMGRPVSYERAVAWKVMNEEENAHCICFMFINWSFV

SEQ ID NO: 615 - protein, 100 aa, Eucalyptus grandis
MAFAGTTQKCMACEKTVYLVDKLTADNRIYHKACFRCHHCKGTLKLGNYNSFEGVLYCRPHFDQLFKRTGSLEKSFEGNPQDLQSPEKPVVERDLQRPKA

SEQ ID NO: 616 - protein, 93 aa, Eucalyptus grandis
MAFKSPGGITWLKHLLVKNFYLGEHLKCRNGLIKKAYELSVLCDIDIALIMFSPSDRVSHFSGKRRIEDVLTRFINLTDQERDTPRCPGSAHT

SEQ ID NO: 617 - protein, 41 aa, Eucalyptus grandis
MGRGRVQLKRIENKINRQVTFSKRRNGLLKKAYELSLLCDA

SEQ ID NO: 618 - protein, 62 aa, Eucalyptus grandis
EISVLCDADVALIVFSTKGKLFEYATDCCMERILERYERYSYAESQVLTNNAETNGNWTLEH

SEQ ID NO: 619 - protein, 86 aa, Eucalyptus grandis
DSSHPQSVSEVNTQFYQQEASKLRRQIREIQVSDRHLLGEGISDLSFKDLKNLESKLEKSISRVRSKKNEMLFAEIEYMQMRGLVQ

SEQ ID NO: 620 - protein, 99 aa, Eucalyptus grandis
ENSRNEWDILSNGGQVQEMAHIANGRDPGNSVSLLRVNNANSSQSNMLILQESCTDSVGAYVIYAPVDIVAMNVVLNGGDPDYVALLPSGFAILPDGPE

SEQ ID NO: 621 - protein, 72 aa, Eucalyptus grandis
TEQVHFLEKNFELENKLEPERKIQLAKDLGLQPRQVAIWFQNRRARWKTKHLEKEYEDLQASYNSLKADCDG

SEQ ID NO: 622 - protein, 79 aa, Eucalyptus grandis
NRQVTFAKRRNGLLKKAYELSVLCDAEVALIIFSTRGKLYEFCSSPSMLKTLDRYQKCSYGSVEVNKPSKELENAYREY

SEQ ID NO: 623 - protein, 242 aa, Eucalyptus grandis
MGRGRLQLKRIENKINRQVTFSKRRAGLLKKAHEISVLCDAEVALIIFSAKGKLFEYSTDSCMERILERYERYSYSEHQVLASETESIGSWTLEHAKLKARLEVLHRNYRHFMGEDLDSLSLKDLQNLEQQLESALKHIRSRKNQLMHESISVLQKKDRALQEQNNLLTRKVKEKERALAQQAQWEQQDHALDSPVVLPHYLPSLDINGSYQARHNGHDDGENLTQPRAGTLLPPWMLHRLN

SEQ ID NO: 624 - protein, 360 aa, Eucalyptus grandis
MKRLGSSDSLGALMSICPPSEELQHSPRNGNPIYHSRDLQSMLELGLDEEGCVEDQSAGGGGHVGGEKKRRLSIDQVKALEKNFEVENKLEPERKVKLAQELGLQPRQVAVWFQNRRARWKTKQLERDYGVLKSSYEALKLSYDALKHDNEALHKEIKELKSKLREEDDNPESNLSVKEEVIIPGHDVSDKIRAADDGDDDTKRSPPPPITAPPRELSFNNGGLKDGSSDSDSSAIVNEENAATSSSSPNPAVQSHGGFLKFMGSSSSSASPPPPPPASFGGCFSFQFQRAYQPQPQPPHHHHHHSPYVKMEEHNFLGGEEDCNFFSQQQAPNPQWERPQQGKRRKTNSPRGRGLQIRDR

SEQ ID NO: 625 - protein, 75 aa, Eucalyptus grandis
MGEESFIYSFVARGTMILAEYTEFTGNFPAIAAQCLQKLPSSNNKFTYSCDHHTFNFLLEDGYAYCVVAKESVGQ

SEQ ID NO: 626 - protein, 53 aa, Eucalyptus grandis
IPFSLFPPQSEGFFNPMDGNLSLQIGYNPTCLDEMNASVSSQNVAGFIPGWML

SEQ ID NO: 627 - protein, 50 aa, Eucalyptus grandis
AGGEPMWIAGPDGSSSVLNEDEYIRAFPRGIVTNPTGFKREPHDKPGSSS

SEQ ID NO: 628 - protein, 232 aa, Eucalyptus grandis
LGTQIPSGIHMPSANLSSISFLGPIPMVSGDGGGRTGSERSRNADCAPAGFPGGDEDVNKGGDIPYGMSTIVRVIPNSRYLRVAQQLLDEIVNVRKALKRSDDANDQSRHENQRSPKDADGGSKNEASSNPQESASNSSELSAAEKQDLQNKLTKLLSMLDEVDKRYKQYYHQMQIVVQSFDTIAGSGAAKPYTALALQRISRHFRCLHDAITGQIQATRKSLGEQDTSTET

SEQ ID NO: 629 - protein, 69 aa, Eucalyptus grandis
LDILEWILELIGVTYRRLDGSTQVTDRQSIVDTFNNDTSIFACLLSTRAGGQGLNLTGADTVVIHDMGF

SEQ ID NO: 630 - protein, 62 aa, Eucalyptus grandis
CWHHVHTQCGKAGFGMLKQENLSNELDRVKKENDNLQIQLRHLRGRHNITEPQRADNPRRHS

SEQ ID NO: 631 - protein, 113 aa, Eucalyptus grandis
GSKELESLERQLDGSLKQIRSRRTQYMLDQLTDLQHREQLLHEANRTLNQRLMEGYQVNALQLNQHAEEVGGYGHPPPPPLPPQPLAQPHSEAFFIPWNVNPLCKWDTSPIQC

SEQ ID NO: 632 - protein, 393 aa, Eucalyptus grandis
MVEGERNGDDDGASQGEQQWKHQQALDRLGKYVRYTAEQVEALERVYSECPKPSSLRRQQLIRECPILSNIEPKQIKVWFQNRRCREKQRKEASRLQTVNRKLTAMNKLLMEENDRLQKQVSQLVCENGYMRQQLHTTSATTTDASCDSVVTTPQHSLRDANNPAGLLSIAEETLAEFLSKATGTAVDWVQMPGMKPGPDSVGIFAISQSCSGVAARACGLVSLEPTKIVEILKDRTSWFRDCRSLEVFTMFPAGNGGTIELVYTQIYAPTTLAPARDLWTLRYTTTLENGSLVVCERSLSGSGAGPNPASAAQFVRAEILPSGYLIRPCEGGGSIIHIVDHLNLEAWSVPEVLRPLYESSKVVAQRITIAALRYIRQIAQETSGEVVYGLGR

SEQ ID NO: 633 - protein, 84 aa, Eucalyptus grandis
MGIDDLCNTGLVLSLGLETPFKIEAQRQAKQRLNFEPSLTLCLSGTTKATRDEQPPADHLYRQASPHSHNSLSAVSSFSSPRVK

SEQ ID NO: 634 - protein, 67 aa, Eucalyptus grandis
ESGEARRLRDSLVEMANVGKSPSMLTECGLAENSLVSIAERVTHHRWSWSEVKYLSDCHLMALDASL

SEQ ID NO: 635 - protein, 103 aa, Eucalyptus grandis
YSEASSDEGNQYSTREEEGEIEEFEEDTYSGAPGALPINKDQSDEDVPAEECDEYPWTSERTRNNHLPEEAGFSGSSADSPRGIRMASPSASSQKFGSLSALD

SEQ ID NO: 636 - protein, 299 aa, Eucalyptus grandis
MAFHNHLSHQDLSSLHHFAADQQPPPPQHQQQQQHLPDSSSSVHHQLHHAAGPNWLNTALLRSDAAAAAAAAAGGNSFLNLHTSSDSAASPQAQQQPPATSASAAAGHHQWLSRQHSSLLQRNHSEVIDADSIIDSADLKESVSKGDGGGGGAAESNWENAKYKAEILAHPLYEQLLSAHVACLRIATPVDQLPRIDAQLAQSQHVVAKYSAMSQGLVADDKELDQFMTHYVLLLCSFKEQLQQHVRVHAMEAVMACWEIEQSLQSLTGVSPGEGTGATMSDDEDDQVDSDANLFDGSL

SEQ ID NO: 637 - protein, 91 aa, Eucalyptus grandis
MGRRKIEIQPITHERNRSVTFLKRKNGLFKKAYELGVLCSVDVAVIIFEDRPGHSPKLYQYSSRGIQDIVQRHLHHDGETDNRGPGDFSGA

SEQ ID NO: 638 - protein, 129 aa, Eucalyptus grandis
MFSTGEYSAAAFEGMDSLPSPRKKKNQLVNRRRFSDEQIRSLESIFESESRLEPRKKLQLARELGLQPRQVAIWFQNKRARWKSKQLERDFAILRANYNALYSRFESLKKEKQSLVTQIEKLNQLVEKP

SEQ ID NO: 639 - protein, 101 aa, Eucalyptus grandis
MLYRGGMRTPNAQQIEQITAQLSKYGKIEGKNVFYWFQNHKARERQKQKRNSLGLSHCSRTPTTAATIATVTLNTTKVHRTILPYFFPHSGIGVRALHDAC

SEQ ID NO: 640 - protein, 85 aa, Eucalyptus grandis
TPSSPASDQILSSCTPQDFHGVASLLGKRSMSFTGIDVGDDPNINNGNVNGEEDLSEDDGSQPGGEKKRRLNMEQVKTLEKNFEL

SEQ ID NO: 641 - protein, 162 aa, Eucalyptus grandis
GKATASGGGGGYMSSPVPLGPFTGYASILKGSRFLRPAQQLLEELCEAGRAICTEKMTDDSCAMTEPAMDSLSGGCGIGMDDGCGGDGGEFRRKKSRLISMLDEVCRRYKQYCQQMQAVVASFECVAGLSNAAPYANLALKAMSKHFKCLKNAIADQLQFTN

SEQ ID NO: 642 - protein, 155 aa, Eucalyptus grandis
MGQQSLIYSFVARGTVILAEYTEFTGNFTSIASQCLQKLPATNNKFTYNCDGHTFNYLVENGFTYCVVAAESAGRQIPIAFLERIKDDFNKRYGGGKATTAAANSLNREFGPKLKEHMQYCVDHPEEISKLAKVKAQVSEVKGVMMENIEKVLDR

SEQ ID NO: 643 - protein, 54 aa, Eucalyptus grandis
EWWSVHNKWPYPTEADKIALAKSTGLDQKQINNWFINQRKRHWKPSEITHYKVI

SEQ ID NO: 644 - protein, 308 aa, Eucalyptus grandis
MAMQTGIGLSKILVLAGAGYTGTILFQNGKLSDLLGELQGLVKGLEKSGSQSDGDKDYSDAVAAQVRRLAMEVRQLASARQITVLNGNSSQMGNLTNMVVPAATLGALGYGYMWWKGLSFSDLMYVTKRGMANCVANLTQHLEHVSEALNSVKKHLTQRIENLDGKMDDQRELSKEIKNEVSSVKANLDGLGDDLDFLQRMVSGLDVRMGSLEYKQDWANEGVRYLCGVASGQKVEMPKMLQEQIKISGTSRGLLSYQDTPSLKGLKEIADALTLSIDRSASDAVVQDGVERLNGKPKPLPRASSTTC

SEQ ID NO: 645 - protein, 197 aa, Eucalyptus grandis
MEEYGQMNENSSTGSRGNNSFLYASPVLGPSSSGNSNYGRGNSSGGHFYSQSGDHCFQSEAPPHPVVKTEATTSHHGHAQKFHHYSLVRDHHDPSASHHHHHQHHQHQQLQTASESSREVDAMKAKIIAHPQYSNLLEAYMDCQKVGAPPEVVAKLSVARQEFESRQRSSVASADGSKDPELDQFMEAYYDMLVKYR

SEQ ID NO: 646 - protein, 304 aa, Eucalyptus grandis
EEGEDEQVLQPKIKRKRSLRVRPRHTMERPEEKSSNGALPVQCGDSAFLPLQMDHKYQPQSRTASETNPFGEPTASKHGHGGPSMKSKRQTSLRRINDPSKLHPLPKSSRSNHISSSDAAAERSRENWNGRVANPSGNSSVGAGLSEIIQRKCKNVVSKLQRRIDKEGHHIVPLLTDLWKRMGSPGHMGGVGSNLLDLRKIDQRIEKLEYGDVMDLVLDVQLMLKGAMQFYGFSHEVRSEARKVHDLFFDILKIAFPDTDFEEVRNALSFSGPGAASQSAPSPKQASAGQSKRHRALNEVDADK

SEQ ID NO: 647 - protein, 166 aa, Eucalyptus grandis
VVGKALQKCAKISTDLKKALYGSSVASCEHYSEVEASSNRIVTQDDVDAACGADDTDFQPVLKPYQLVGVNFLLLLHRKGVGGEGQGVLKYDTSLANGASLYSMQAILADEMGLGKTIQAITYLTLLKHLNNDPGPHLVVCPASLLENWERELKRWCPSFSVLQYH

SEQ ID NO: 648 - protein, 142 aa, Eucalyptus grandis
MFMVDDHALCLSCNCTFNILACCNCSYPKDSDKHMLAKQAGLTRSQVSNWFINARVRLWKPMVEEMYLEETKSREQAGSENGTTRRAATKSNKDAAGLKSASQEDNAFGMNSSIKSFQSSPNKALNQAAISPSENSNSTSST

SEQ ID NO: 649 - protein, 131 aa, Eucalyptus grandis
GAPASGQSSHALQVEETRDSPLGFVVKVEDRLSSGSGGSAVVDEDGPQLVDSGHSYFHCNDYPGSLVAVNGLQSEDDGSDDSRGYCSEIFAAAEEPHQEGGVPNGVVGVALVLGFRLLVCSRKWFKSNMCS

SEQ ID NO: 650 - protein, 152 aa, Eucalyptus grandis
SRLQAVNRKLTAMNKLLMEENDRLQKQVSQLVYENSYFRQQTQNATLATTDTSCESVVTSGQHHLTPQHPPRDASPAGLLSIAEETLTEFLSKATGTAVEWVQLPGMKPGPDSIGIIAISHGCTGVAARACGLVGLEPSRVAEILKDRPSWY

SEQ ID NO: 651 - protein, 151 aa, Eucalyptus grandis
DDVCGGGKRPERPFFCTYDGEENGDDDYDEYLHQPEKKRRLSIEQVLYLEKSFETDNKLEPDKKVQLAKELGLQPRQVAIWFQNRRARWKTKQMEKDFDKLQASFNCLKSDYESLLNEKEKLKAEVIHLTHQLEQRSNGILNHSTYLNNCT

SEQ ID NO: 652 - protein, 85 aa, Eucalyptus grandis
TAKLKSSIFLLPLHQRLILKKIERQQVFRDGFLVLLEGGLAMGIEEATKRQSIFSYPEDLYNEEYYDDQAPEKKRRLTPEQVHLL

SEQ ID NO: 653 - protein, 99 aa, Eucalyptus grandis
MEWEKQEQHHPHHHHHPHHHPQQQQQHHQQQQQPQQQQQAKEAQQQQQQQGGEGMGNGTAAGNGGGVLYVKVMTDEQLETLRKQIAVYASICEQLVEMH

SEQ ID NO: 654 - protein, 150 aa, Eucalyptus grandis
ARGPVLLAEYTEFSGNFTSVASQCLQKLPATSNKFTYNCDGHTFNYLVDDGLTYCVVAVESVGRQIPMAFLERIKEDFTHRYDAGKAATASANSLNREFGPKLKEHMQYCVDHPEEISKLAKVKAQVSEVKGVMMENIEKVLDRGEKIEL

SEQ ID NO: 655 - protein, 96 aa, Eucalyptus grandis
LQYDWHHLSFCVIISVLNLQNTINGSCSMESILERYERYTYAERQQVATDSPQVQGSWSLEYPKLVARIEVLQRNIRNLSGEELDPLSLRELQYLE

SEQ ID NO: 656 - protein, 338 aa, Eucalyptus grandis
MATYYHQSSSDPDGALQTLVLMNPASYVHYSDAPPPHQQPSAIFLNSSTAGPPASQTQQFVGIPLPGSAADSQPSSMHVNHDLSSMHGFMPRVQYNLWSSLDPSTAAREASRTHQQQGLSLSLSPQQPPPTPAGYRSFVRAERSGDGAAGSQHPPAISGGEDVRISGGSPSSASGVTNGAAVGSGMQGVLLSSKYLKAAQELLEEVVNVGNTGIKAEMLKKASGQSKPGGESAALKEEGGGDGSGKRGAELSMAERQEIQMKKAKLINMLDEVEQRYRQYHNQMQIVISSFEQAAGIGSARTYTALALQTISKQFRCLKDAIAGQIRAANKSLGEEDG

SEQ ID NO: 657 - protein, 123 aa, Eucalyptus grandis
VEQVQFLEKSFEVENKLEPDRKIQLAKDLGLQPRQVAIWFQNRRARWKTKQLEKDYETLQASFNTLKSDYDTLIKERNDLKAEVLNLTDKLLHKGNEKESSESSSKSSQGLFQNPIADSVSED

SEQ ID NO: 658 - protein, 128 aa, Eucalyptus grandis
AIISSDQMERRMLEAARKGNVHELEDLISSNELILEEMDLEGAGHTPLHVACVAGHLDFVRELLKRTPKLAEKVNTDGFSPLHIAAARGDVEIARELLTMGPHLCSVKGRERRIPLHYAAMNGKVDVM

SEQ ID NO: 659 - protein, 159 aa, Eucalyptus grandis
RLSKDQSAVLEESFKEHNTLNPKQKLALAKQLGLRPRQVEVWFQNRRARTKLKQTEVDCEYLKRCCESLTEENRRLQKEVQELRALKLSPQFYMHLSPPTTLTMCPSCERVAAPSPPSAVGRPLAAVPAHPRPVPLINPWAPAAALEIVDPPGLQEFDI

SEQ ID NO: 660 - protein, 115 aa, Eucalyptus grandis
MAREKIKIKKIDNVTARQVTFSKRRRGLFKKAGELSVLCDAEVAVVIFSATGKLFEYSSSSMKDTLERYTLHHNNLENMDQPSLELQLEHSNNMRLSKEVAEKSHRLRQLRGEDL

SEQ ID NO: 661 - protein, 118 aa, Eucalyptus grandis
QVAVWFQNRRARWKTKQLERDYDYLKSSYDSLLSDYDSILKENEKLKLEVYSLTEKLQGKEVDGAPMTGPSEPAPLEEADVQAVQFSAKVEDRLSTRSGGSAVIDEEGPQLVDSGNSY

SEQ ID NO: 662 - protein, 74 aa, Eucalyptus grandis
MEAGRFLFDPPALQGNILFLDKGSRSMMGMEESPKRRRFFCSPDELFDEEYYDEQMPEKKRRLTPEQVLLLEKS

SEQ ID NO: 663 - protein, 152 aa, Eucalyptus grandis
MYGLCGGGGGGGGGGGEEYSERALMSPENLVLPSEYQAWLCSAGFRDNRIPMYGFGSEEFVSSASGMSETASVTPDQEDAAETAIKSKIKSHPSYPRLLHAYIDCQKVGAPPEVVGLLDEIRPENGVCKRDAAVSTCLGADPELDEFMETYT

SEQ ID NO: 664 - protein, 56 aa, Eucalyptus grandis
MALAMHRECSSKQMDASKYVRYTPEQVEALERVYNECPKPSSLRRQQLIRECPILC

SEQ ID NO: 665 - protein, 135 aa, Eucalyptus grandis
MAGEEPYSADTNSDTFADEETLIPSSSEALESAWVPTSSTAHHGSKSVVNFEDVCGGGDTNTAPRPYLRQIDLKEEAVEEDYGDGNFQPPGKKRRLSADQVHFLERHFEVENKLEPERKIQLAKDLGLQPRQVAI

SEQ ID NO: 666 - protein, 226 aa, Eucalyptus grandis; identical to SEQ ID NO: 612

SEQ ID NO: 667 - protein, 147 aa, Eucalyptus grandis
VLLRFLTTATTICNNNAGGSGSGSGSGCFFMDNDVKAKIMAHPHYHRLLSAYVNCQKVGAPPGVVAKLEEACASAAIMAGNSGMSNTGCIGEDPALDQFMEAYCEMLTKYEQELSKPFKEAMLFLQRIECQFKALTLGVPSDSVALS

SEQ ID NO: 668 - protein, 176 aa, Eucalyptus grandis
GSSKGVGIPRLRFLDQQLRQQRALQQLGMMQQHAWRPQRGLPESSVSILRAWLFEHFLHPYPKDSDKILLARQTGLTRSQVSNWFINARVRLWKPMVEEMYKEEIGDAEMDSNSSSDTAKPKTGDIKSSMEDRVEEVQQSSTATQRCSSGQLMDSSFDRTPDVEMAGHSVGFNYLN

SEQ ID NO: 669 - protein, 294 aa, Eucalyptus grandis
MSEVQVTQMKSDGTLEESGEARRLRNSLEEMANEGKSPSILKECGLPENSFVSIPQKMTENRWSWSEVKYLSNCLLLALDASLEHSLLGSLMNMDRYAAAESYHKLAMAFAPVPDLHIMWLLHLCDAHQEMQSWAEAAQCAVAVAGVVMQALVARNDGVWSKDHVTALRKICPMVSSEISCEASAAEVEGYGASKLTVDSAVKYLQLANKLFSQAELYHFCASILELVIPVYKSRRAYGQLAKCHTLLTNIYESILEQESSPIPFTDATYYRVGFYGEKFGKLDRKEYVYREPR

SEQ ID NO: 670 - protein, 144 aa, Eucalyptus grandis
HTKTHHHHSIAISNPTKSMSQDYHHPSIFAFSNNGFERPDVAAASAASDQEQQHHVAQQICRDKLRVQGFDQPPPPQLVGMEEEPGGLPAYETAGMLSEMFNFPPGGAAAAELLEQPMASGYRAARPSLPTVSGTAQKTQVCIG

SEQ ID NO: 671 - protein, 125 aa, Eucalyptus grandis
IVDHMDLEPWSVPEVLRPLYESSTLLAQRTTMAALRNLRQISQEVSQPNVTGWGRRPAALRALGQRLSKGFNEAVNGFMDDGWSMLESDGVDDVTLLINSSPAKMAGVNISYASGFPSMTSAVLC

SEQ ID NO: 672 - protein, 104 aa, Eucalyptus grandis
MATAFAGTQQKCKACDKTVYLVDQLTADNKVFHKACFRCHHCKGTLKLSNYCSFEGVLYCKPHFNQLFKMTGSLDKSFEGTPKTVNRSSEQGQSNAKVSSMFAG

SEQ ID NO: 673 - protein, 131 aa, Eucalyptus grandis
DDDEDDDLFQDRFSIAYNLDREFGPRLKEHMQYCMSHPEEMSKLSKLKAQISEVKGIMVDNIEKVLDRGERIELLVDKTENLQFQADIFQRQGRQLRRKMWFQNLQMKVVVAGAVVIVIFLLWLIAKWGSK

SEQ ID NO: 674 - protein, 90 aa, Eucalyptus grandis
MATAFAGTQQKCKACDKTVYLVDQLTADNKVFHKACFRCHHCKGTLKLSNYCSFEGVLYCKPHFNQLFKMTGSLDKSFEGTPKTVNRSSE

SEQ ID NO: 675 - protein, 95 aa, Eucalyptus grandis
VYAPIDSTAMTIALSGEDTSTVQILPSGFTISSDGRIGTSSSKPAGTLLTVAFQILVSSHSGPEQLSVESVATVNTLISATVQKIKAALNWSAAE

SEQ ID NO: 676 - protein, 141 aa, Eucalyptus grandis
QMERAARKGNIHELNDLISSNEQILEEMALEGAGHTPLHIACMGGHLDFIRELLKHMPKLAEKVNPCGFSPLHIAAARGDVEIAKELLKVNTDLCSVEGRERRIPLHDAVIHGEVDVMEILLSTSPESVEKKTARKETVLH

SEQ ID NO: 677 - protein, 121 aa, Eucalyptus grandis
PSDIFLLQLCNGVDENAVGTCAELLFAPIDASFSDDAPIIPSGFRIIPLDPGSDAFSPNRTLDLASALDVGPTGNKAVGDNSGHSGNTKSVMTIAFQFAFELHLQENVASMARQYLRSIIA

SEQ ID NO: 678 - protein, 34 aa, Eucalyptus grandis
MGIDDLCNTGLVLSLGLETPFKIEAQRQAKQRLN

SEQ ID NO: 679 - protein, 110 aa, Eucalyptus grandis
INAPESDPSLTPAINRHPFSETQATTLLQATTAMISSAVQVAGPAHIDDPCRRSIGGSTGLGGATDIGSALIRFGTAAAATGDVSLTLGLRHAGNVPEKSSFSVTDLGGC

SEQ ID NO: 680 - protein, 146 aa, Eucalyptus grandis
FNEGNGTPSKQKIKEITTELSQHGQISETNVYNWFQNRRARSKRKMQNATGNNTESEAEAEVESPKEMKTKPEIFQSQQNPVSRNEDLCFQSPEISSDLHFADSQTKVESMVYPDGSLRSRNRNLGQLSFYDAMMSNSGGLAGNEH

SEQ ID NO: 681 - protein, 247 aa, Eucalyptus grandis
PIDESFADDAPLLPSGFRVIQLDPKTDGPAPTRTLDLASTLEVGSGGARPTCEADASTYNLRSVLTIAFQFVFENHLRDTVAIMARQYVRSVVGSVQRVAMAIAPSRLGGHLGPKSLSGSPEALTLARWICRSYRICAGAELLRGDSQAGDAVLKEFWHHSDAIMCCSVNTNVASPVFTFANQAGLDMLETTLVALQDIMLEKVLDEGGRKVLSSEFPKIMQQGIAYLPAGVCISSMGRPVAYEQAV

SEQ ID NO: 682 - protein, 147 aa, Eucalyptus grandis
VRLTKEQSALLEESFKQHSTLNPKQKQALARQLNLRPRQVEVWFQNRRARTKLKQTEVDCEFLKKCCETLTDENRRLQKELQELKALKLAQPFYMHMPAATLTMCPSCERIGAGPSVDGAAPTKGPFSMTTKSHLYSHHFTNPSAAC

SEQ ID NO: 683 - protein, 121 aa, Eucalyptus grandis
PLEFHNDVRLTFSNAMTYNPPSNDVHLMADTLNKFFDIRWKTIEKKLVVGGPQPSSTKSAPPEEVKAAKSTALPKKRKMSSQQEVMPAPLLQVMTDEEKHKLGQELESLLGEMPENIIDFL

SEQ ID NO: 684 - protein, 36 aa, Eucalyptus grandis
MQLYAPTTLAPARDFWLLRYTSVMEDGSLVVCERSI

SEQ ID NO: 685 - protein, 120 aa, Eucalyptus grandis
RELKTQLLRKYSGYLGSLKQEFMKKRKKGKLPKEARQQLLDWWSRHYKWPYPSESQKLALAESTGLDQKQINNWFINQRKRHWKPSEDMQFVVMDATHPHYYMDNMLGNPFPMDISPTLL

SEQ ID NO: 686 - protein, 93 aa, Eucalyptus grandis
WPFKEPVDAREVPDYYDIIKDPMDLKTMTKRVESEQYYVTLEMFIADVKRMFANARTYNSPDTIYFKIATRLEAHFQSKVQSNLQSGAGKIQQ

SEQ ID NO: 687 - protein, 185 aa, Eucalyptus grandis
MGRGKIEIKRIENTTNRQVTFCKRRNGLLKKAYELSVLCDAEVALIVFSSRGRLYEYSNNSIRSTIERYKKANSDSSNTSTVTEINAQYYQQESAKLRQQIQMLQNSNRHLMGDSLSSLSVKELKQLENRLERGITRIRSKKHEMLLTEIEYLQKKEIELENESVFLRTKIAEVDRIQQGNMVAA

SEQ ID NO: 688 - protein, 130 aa, Eucalyptus grandis
MGRGKIEIKRIENANSRQVTFSKRRSGLLKKAQELSILCDAEVAVIIFSNTGKLYEFSSSGMKQILSRYNRCQDSPESTVVEYKPESTKEDDKVVDTLKDEIAELQMRQLRLLGKDLNGLSIKELQHLEQ

SEQ ID NO: 689 - protein, 117 aa, Eucalyptus grandis
LDTALKRIRTRKNQLMHESISQLQKKEKSLQEQNNVLSKKIKENEKVMRESGQWEQQTPAPTTSSFMLQPTLPLPSLTIGNTFQTPHVLGGAEQEERSQARPANTLMPPWMIRRSNE

SEQ ID NO: 690 - protein, 140 aa, Eucalyptus grandis
YLSDLMSSGHKHKRRKQLQTVELKVRMDCDGCELKVRKALSSLDGVKTVEINRKQQKVTVNGYVDQNKVLKRAKSTGKKAEIWPYIPYSVVAHQPYIAQSYDKKAPPGHVRKVEPTATSAIVTRHEDPYMTLFSDDNPNA

SEQ ID NO: 691 - protein, 68 aa, Eucalyptus grandis
RIENKINRQVTFAKRKNGLLKKAYELSVLCDAEVALIIFSSRGKLHEFCSGPRYRVFVCYHLFFSLML

SEQ ID NO: 692 - protein, 140 aa, Eucalyptus grandis
INAGRFDQRTTHEERRLTLETLLHDEERYQETVHDVPSLQEVNRMIARSEEEVELFDQMDEELDWTEEMTNYELVPKWLRASTKEVNAAIATLSKKPSKNTLFASTIVEPNEPVSESVRKRGRPKSKKHPNYKELDDDNE

SEQ ID NO: 693 - protein, 126 aa, Eucalyptus grandis
AAQLKHSCELLGEKDGAGSSGITKGETPRLKLLDQSLRQQRAFHQMGMMEQEAWRPQRGLPERSVNILRAWLFEHFLHPYPSDADKHLLARQTGLSRNQVSNWFINARVRLWKPMVEEMYQQESKE

SEQ ID NO: 694 - protein, 53 aa, Eucalyptus grandis
FCSMLKTLERYQKCNYGALEPNVSARESLELSCQQEYLRLKARYEALQRTQRY

SEQ ID NO: 695 - protein, 86 aa, Eucalyptus grandis
KIEDVREEILRKRRAGKLPGDTTSVLKNWWQQHSKWPYPTEDDKAKLVEETGLQLKQINNWFINQRKRNWHNNSQSVTSLKSKRKR

SEQ ID NO: 696 - protein, 99 aa, Eucalyptus grandis
PVDITGMQAVMTGCDSSNIAALPSGFSILPDGIESRPLVISSRHEEKSSEGGSLLTIAFQILTNTSPTAKLTVESVESVNTLISCTLRNIRTSLQCEDG

SEQ ID NO: 697 - protein, 134 aa, Eucalyptus grandis
ENKINRQVTFAKRRNGLLKKAYELSVLCDAEVALIIFSHRGKLYEFCSSSSMLKTLERYQKCNYGAPEPSISTREAQLELSSQQEYLKLKARYEALQRTQRNLLGEELGPLSSKELESLERQLDSSLKQIRSTR

SEQ ID NO: 698 - protein, 145 aa, Eucalyptus grandis
MQEPNLAMMGGGGGGGGGGGGIVGGGGGGLGSEASFSGDHPQRQLKGEIASHPMYEQLLSAHVACLRVATPIDQLPLIDAQLAQSHHLLRSYASSVQHGHSSLSPHDRQELDHFLAQYLVVLCSFKEQLQQHVRVHAVEAVMACR

SEQ ID NO: 699 - protein, 160 aa, Eucalyptus grandis
HPDEKQRQQLSKQLGLAPRQVKFWFQNRRTQLKAIQERHENSLLKTEMEKLRDENKAMRDTIQKSCCPNCGSATTSRDTALTTQEQQLRIENARLKAEVEKLRTALGKYTPGTASPSCSAGNDQENRSSLDFYTGIFGLDKSKIMELVNQAMEELKKMAT

SEQ ID NO: 700 - protein, 72 aa, Eucalyptus grandis
PTTRTPGTKKKKSSNKKSLQGERERARTQETLNLSSPVSSKRAREKEREREREREREGVEVEERAREEEGVY

SEQ ID NO: 701 - protein, 205 aa, Eucalyptus grandis
LIRPCEGGGAIIHIVDHVDLDAWSVPEVLRPLYESSKILAQKMTVAALRHIRQIAQESSGEIQYGGSRQPAVLRTFSQKLCRGFNDAVNGFVDDGWSVLSSDGVEDVTIAVNSSPNKFLGSQYNATIFPNFGRGVLCAKASMLLQNVPPAVLVRFLREHRSEWADHGIDAYSAASLKTSSYAIPCVRPGGFPSSHVILPLAHTVE

SEQ ID NO: 702 - protein, 126 aa, Eucalyptus grandis
LFEHFLHPYPKDSDKVMLAKQTGLTRSQVSNWFINARVRLWKPMVEEMYTEEIKEQEQNGGGAEEKPSKSEREDSASKSSGLQDKAPNSNENSTKSFKPKEITSRNHDTPAISTNSASSIGGNVRS

SEQ ID NO: 703 - protein, 116 aa, Eucalyptus grandis
DKLMKHEYGWVFNTPVDVKGLGLHDYYSIIKHPMDLGSVKTRLNRNWYKSPKEFAEDVRLTFRNAMTYNPEGQDVHVMAEILYKIFEDRWAIIESDYNREMRFALDYDMGLPTPTS

SEQ ID NO: 704 - protein, 116 aa, Eucalyptus grandis
PSYGNGYSPPQYGNGPAYHPMPTYYPMGYRICAGCNTEIGHGRFLSCMNAVWHPECFCCRACTLPISDYEFSLSGNYPYHKSCYKEHYHPKCDVCSHFIPTNLAGLIEYRAHPFWS

SEQ ID NO: 705 - protein, 96 aa, Eucalyptus grandis
TWPEDICSVKSDMFDSESPHYTDAAHSSLLEPGDSSYAFEPDHSDLSQDEEDNLSKSLLSTRNYPKLENSDYAILPPNSCNFGFHAEDPAFWPWSY

SEQ ID NO: 706 - protein, 149 aa, Eucalyptus grandis
EGKLGHSNSSNSLDNGKYVRYTPEQVEALERLYHECPKPSSLRRQQLIRECPILSNIEPKQIKVWFQNRRCREKQRKEASRLQAVNRKLTAMNKLLMEENDRLQKQVSQLVYENGYFRQHTQNTTLATKDTSCESVVTSGQHQLTSQHP

SEQ ID NO: 707 - protein, 134 aa, Eucalyptus grandis
EENMQHLKDEAANMMKKIELLEDSRRKLLGEGLGSCSIEELQQIEQQLERSVISIRARKTQVFKEQIDKLKEKEKMLTAENAILTEKCGIKPPQRANECRDSPLLRESTPSSEVETGLFIGPPETRSRRLPFQN

SEQ ID NO: 708 - protein, 124 aa, Eucalyptus grandis
DKDPKRPVRDPVFAAVPDKFVASMMKRCGLILTKVMKHKHGWVFNTPVDAVGLGLHDYHQIIKNPMDLGTVKTNLERNFYHSPQEFAADVRLTFNNALTYNPKGHDVHHMAETLLVQFDQMFDP

SEQ ID NO: 709 - protein, 126 aa, Eucalyptus grandis
VSLSRVEKHASSAMNKLHEAAMKGDLAALQDLLLQDPQILHKTTSSSSDGTPLHVSCLSGHASFTKHLLTHNPELAKEADSRGSLPLHVACAKGDVEIVRALVAVDPAGCLRYDREGRTPLHLAAI

SEQ ID NO: 710 - protein, 137 aa, Eucalyptus grandis
DDLDNERASSRGGGSDEEDGDMSRKKLRLSKDQSAVLEESFKEHNTLNPKQKLALAKQLGLRPRQVEVWFQNRRARTKLKQTEVDCEYLKRCCESLTEENRRLQKEVQELRALKLSPQFYMHLFPSTTLTMCPFCER

SEQ ID NO: 711 - protein, 104 aa, Eucalyptus grandis
ADYDEGGDDNPGSRHPVTRQFFPVEEEEELEEDGERAGMGGAAVPPGFPRAHWVGVRFRQSDHHPIGSGKGSPILEGSQPMKKIRKGPRSRSSQYRGVTFYRRT

SEQ ID NO: 712 - protein, 138 aa, Eucalyptus grandis
DDLDNERASSRGGGSDEEDGDMSRKKLRLSKDQSAVLEESFKEHNTLNPKQKLALAKQLGLRPRQVEVWFQNRRARTKLKQTEVDCEYLKRCCESLTEENRRLQKEVQELRALKLSPQFYMHLSPPTTLTMCPSCERV

SEQ ID NO: 713 - protein, 128 aa, Eucalyptus grandis
ESQKLMEAVQNGDVSAAVDLLDQDPLLLDRIIVLGVSDTPLHAASVLGHADLVRELLRRAPRLASEQDSRGNSPLHLAAGKGHGEIVGELLSADPAAASARNLDGRAPIHVAAIKGRVDAVGRMVGAV

SEQ ID NO: 714 - protein, 93 aa, Eucalyptus grandis
YSGYLSSLKQELSKKKKKGKLPKEARQKLLSWWELHYKWPYPSETEKVALAESTGLDQKQINNWFINHVIECWVKSMATLMQEIFLMTKVILR

SEQ ID NO: 715 - protein, 127 aa, Eucalyptus grandis
TFSFGILKAGEGGDGVADDELGVTRQLFPVREVDADMEWCGESSSLDKRSDVFLVGACKEKEGPRLAMPQQRRKSRRGPRSRSSQYRGVTFYRRTGRWESHIWDCGKQVYLGGFDTAHAAARPMIEL

SEQ ID NO: 716 - protein, 35 aa, Eucalyptus grandis
SEDMQFMVMDGLHPQGAALYMDGHYIGDGPYRLGP

SEQ ID NO: 717 - protein, 179 aa, Eucalyptus grandis
AAFEGMDSLPSPRKKKNQLVNRRRFSDEQIRSLESIFESESRLEPRKKLQLARELGLQPRQVAIWFQNKRARWKSKQLERDFAILRANYNALYSRFESLKKEKQSLVTQIEKLNQLVEKPQGEGQSCGHDLATNSTDRESDNGVPKYEDSQPVFPDKLTRLMGIPCEDDYFGLKRAEPP

SEQ ID NO: 718 - protein, 142 aa, Eucalyptus grandis
NLTDKLLHKGNEKESSESSSKSSQGLFQNPIADSVSEDEVSRVPIPTWPEDICSVKSDMFDSESPHYTDAAHSSLLEPGDSSYAFEPDHSDLSQDEEDNLSKSLLSTRNYPKLENSDYAILPPNSCNFGFHAEDPAFWPWSY

SEQ ID NO: 719 - protein, 207 aa, Eucalyptus grandis
EKRTPKKRGRKPGLGRDTPLNHVEAERQRREKLNHRFYALRAVVPNVSRMDKASLLSDAVSYINELKSKIGDLESQLQRESKRVKQEVTDATDNLSTTTSVDHSSPSGCGGSLLEVEVKIVGCDAMIRVQSENANYPSARLMAAMRDLELHIHHASLSTVNDLMLQDVVVSVPEGLKGEEDLRAALLRALEQRSEKLPGEREREYVL

SEQ ID NO: 720 - protein, 128 aa, Eucalyptus grandis
EDDKLGRNRASANVVQSSSVKGRPSGGTLVVCPTSVLRQWGDELKNKVSEKAKLSVCMYHGTTRTKDPYELANYDVVLTTYSIVSMEVPKPAGFKDEKDSLQDDDDAFFGRKRKHSAKSEKRRLKKEM

SEQ ID NO: 721 - protein, 114 aa, Eucalyptus grandis
FRLFINWLLDFNSADSAIDSAHFQILTAFANAFHALQPLKVPAFSFAWLELVSHRSFMPKILSGNSQKGWPYFQRLLVDLFQYMEPFLRNAELGLPVHFLYKGTLRVLLVLLHD

SEQ ID NO: 722 - protein, 183 aa, Eucalyptus grandis
MNRERLMKMAGSVRTGGKGTMRRKKKAVHKTTTTDDKRLQSTLKRIGVNAIPAIEEVNIFKDDVVIQFLNPKVQASIAANTWVVSGSPQTKKLQDILPGIINQLGPDNLDNLRKLAEQFQKQVPGAATGSGATGMQDDDDDEVPELVPGETFEAAAEEGQATQVTEATQVTEATKVTEATPAS

SEQ ID NO: 723 - protein, 54 aa, Eucalyptus grandis
GSCQKGDSCEYAHGVFESWLHPAQYRTRLCKDETGCARKVCFFAHKPEELRPVY

SEQ ID NO: 724 - protein, 124 aa, Eucalyptus grandis
MASSSGTSSGSTLIQNSGSEESLQALMDQRKRKRMISNRESARRSRMRKQRHLDDLMLVVAQLRKDNQQLRDNVNVVNQHYMTLETENSILRVQMNELTNRLESLKDILGILDAGDGGRPGNGG

SEQ ID NO: 725 - protein, 120 aa, Eucalyptus grandis
MTDGHLFNNISLGGRGGSNPGQIKIFSGGISWRRQGGGKAVEVDKSDIVGVTWMKVPRTNQLGVRTKDGLHYKFTGFRDPDVISLTNFFQNTCGLTPEEKQLSVSGRNWGEVDLSGNMLT

SEQ ID NO: 726 - protein, 58 aa, Eucalyptus grandis
RLGPMGPKTLCNACGIRYKTGRLFPEYRPSASPTYVPSLNIVSNEIPSSHLWLSLLQK

SEQ ID NO: 727 - protein, 78 aa, Eucalyptus grandis
GVAIDVKIMGWDEVVRVESGRKDHPAARLMVALQELNLELQHASVSVVNELMIQQATVKMGSQLYTQEQLKAALLAVI

SEQ ID NO: 728 - protein, 123 aa, Eucalyptus grandis
KPPMKKQKSKPAAASETAGPARRCSHCGVQKTPQWRAGPNGAKTLCNACGVRFKSGRLYPEYRPACSPTFSSELHSNHHRKVLEMRRKKESMTTTALGQPEPGRARAQLLRARVGSSWRPREI

SEQ ID NO: 729 - protein, 213 aa, Eucalyptus grandis
AAGLLRCGKSCRLRWINYLRPDLKRGNFTEEEDEIIIKLHSLLGNKWSLIAGRLPGRTDNEIKNYWNTHIRRKLLNRGIDPATHRLINEPAQDHHDEPTISFAANSKEIKEMKNNAELNFMCNLEESADVASSARERCPDLNLELGISPPSHQLHQPEPLLRFTGRKSDLCLECNLGLKNSQNCRCSVGVIESETSVGYDFLGLKASVLDYRS

SEQ ID NO: 730 - protein, 61 aa, Eucalyptus grandis
MSVLSKSDSVEIREVWEYNLEDEFSFIREIVDDYPYIAMDTEFPGMVLRPVGNFKSSSESH

SEQ ID NO: 731 - protein, 94 aa, Eucalyptus grandis
MRRKKKAVHKTTTTDDKRLQSTLKRIGVNAIPAIEEVNIFKDDVVIQFLNPKVQASIAANTWVVSGSPQTKKLQDILPGIINQLGPDNLDNLGS

SEQ ID NO: 732 - protein, 103 aa, Eucalyptus grandis
YWETLMFFQSEELLHNSCVSEVISRFNGPSSPDAAALPVASKSIDLERNRRKKLNERLFALRALVPKISKMDKASIVKDAIDYIQDLREQEGRSEPRSQSSNL

SEQ ID NO: 733 - protein, 78 aa, Eucalyptus grandis
GVAIDVKIMGWDAVVRVESGRKDHPAARLMVALQELNLELQHASVSVVNELMIQQATVKMGSQLYTQEQLKAALLAVI

SEQ ID NO: 734 - protein, 122 aa, Eucalyptus grandis
GIYSCLNLDASNGGSSAIDPSISSAILDDFCTIKDGPFPNLSDCLVGNFSSSQDVQSQITSASLADSQAFSRQDFPDNSGGTSSSNVDFDESSILKNSTWQQQVAPPMRTYTKVQKAGSVGR

SEQ ID NO: 735 - protein, 133 aa, Eucalyptus grandis
MGSSASSQRPDNLQDKVGPVSVSDEEWKKRLTPEQYYVARQKGTERAFTGEYWNTKTPGTYHCVCCDTPLFESNTKFDSGTGWPSYYQPIGNNVKSKLDLSIIFMPRQEVLCAACDAHLGHIFDDGPPPTGKR

SEQ ID NO: 736 - protein, 163 aa, Eucalyptus grandis
MVDKCGEGLLVAVEAQKAVPAPFLTKTYQLVDDPSTDHIVSWGDDDSTFVVWRPPEFARDLLPNYFKHNNFSSFVRQLNTYGFRKIVPDRWEFANEFFRKGEKHLLCEIHRRKTAQPQLTHHHPHSASPLSGPTPAFFPFPSRLSISPSDSDDQHSSHWCDSP

SEQ ID NO: 737 - protein, 172 aa, Eucalyptus grandis
MALEALSSPTAPSAPFQFMKDSSPAAAAAAASSSSSAYDLPLAEPWAKRKRSKRPHNPPSEDEYLALCLIMLARGGAGRTLPPPPPPAVSSEAAKVAYRCPVCDKGFPSYQALGGHKASHRKHASSAAAAAGGDDQPTTSSTSAATTSSGVSGKVHECSICHKSFPTGQALG

SEQ ID NO: 738 - protein, 78 aa, Eucalyptus grandis
ISSSRWPRQETLTLLEIRSRLDPKFKEANQKGPLWDEVSRIMSEEHGYNRSGKKCREKFENLYKYYKTTKEGKAGRQD

SEQ ID NO: 739 - protein, 135 aa, Eucalyptus grandis
MGPQMNFRNLADVPAAERSTGGQPGIPLLSRQSSVYSLTFNEFQNTWSGLSKDIGSINMDEFLKNIWTAEESQLQLQDMAPSGNGGEGGGQVGNLLRQGSLTLSRTISQKTVDEVWRELFKETEDVKEGSREGGD

SEQ ID NO: 740 - protein, 49 aa, Eucalyptus grandis
DFERNRAEGVDSARFAELMISSGLLCNDAVIWVTFHSAYDFGYLVKILT

SEQ ID NO: 741 - protein, 101 aa, Eucalyptus grandis
MNFSDKEVQLASDHPKKPAGRKKFRETRHPVYRGVRLRDSGKWVCEVREPKKKSRIWLGTFPTVEMAARAHDVAALALRGQSACLNFADSAWRLPKPASTD

SEQ ID NO: 742 - protein, 113 aa, Eucalyptus grandis
GMDSRTSSRISGVTLQEVPPTSSQVPEIPPALGASANDPSSAVSELKAPSQGTAKVTTNQFPDMGMLAGAQESEAVSVNQADTVMTGISQTQDMVLEDIANISRDDYMGADLH

SEQ ID NO: 743 - protein, 200 aa, Eucalyptus grandis
KAYARRQHAWLTGANEVDSKTFSRAILAKSARIQTVVCIPLLDGVVEFGTTERVQEDISLVNHVKTFFVDHHPPHPPKPALSEHSTSNPAATSSGHHRFHSPPVPSYAPADPPAAANQGDEEEEDDDDDEEEGESDSEAETGRQGAAAAAQNPHGAGPANNAEPSEFEMSEDIRLGSPDDGSNNLDSDFPMLTINSTAAD

SEQ ID NO: 744 - protein, 327 aa, Eucalyptus grandis
DGSCREPKDGEESEATRILNLRLEDEGQQRMRKRVLDKLHTVFGGSDEDNYALGLDRVTDMEMFFLASMYFLFPSGEGGPGKCFASEKHVWLTDALKSSSDYCVRSFLAKSAGIRTIVLVPTDVGVVELGSVRSVPESSELVQTIRLSFSTNSFMSVKPIAALPMTNEKKDENAPFSNLALAGKGEAISKIFGKELTTVNSPGHYREKLAVRKMDSRQSWEPHHNGSKLPFSTPRNGTQDTSWAHHAHGVKQLSPVEFYGSQTSASKLEERMNSGRNDFGLNRYPTPKQVQMQIDFTGATSRPSVITRPFTADSEHSDVEASCKEEQ

SEQ ID NO: 745 - protein, 361 aa, Eucalyptus grandis
MMMMTMAAGGGDHHARSTPTVQIPPVWDPLDDPATGGCGGPYSPYSPYSPYSGGGNAGGAAGGGECCNDLTALRRFLPSNHHQDEEDEEDGRAPGEDGVLGCDEFRMYEFKVRKCARGRSHDWTECPYAHPGEKARRRDPRRFFYSGTACPDFRKGACKKGDTCEFAHGVFECWLHPERYRTQACKDGQSCRRRVCFFAHSPDQLRVLPAHQQQQQQQQQQQHSPKSATDSEFGSPVRPSAAAAAAFDSYFTKPWSASFISSPTSILTTSSPPISPPTNSPPMSPNQRGGCCGSPGSVSELVACMRNMQIAKMKMSPRGQMGGSLFGSPLRPGCHLAAPVTPRAESSPRYGQLGGGGGGGL

SEQ ID NO: 746 - protein, 78 aa, Eucalyptus grandis
LIRWRKHRRVRWAVGATRAAASRARSSGGVREQDRYLPIANISRIMKKALPANGKIAKDAKDTVQECVSEFISFITSE

SEQ ID NO: 747 - protein, 278 aa, Eucalyptus grandis
MATPDERPSSSSSAASAVAIRQVWAWNLDAEFGLIRDLIDRYPFVSMDTEFPGLVFRRPAGAGAGARPSPSDHYRLLKSNVDALSLIQVGLTLSDARGGLPGFIWEFNFREFDAARDPHAPDSIELLRRQGVDFDRNRAEGIDSARFAELVMSSGLVCNDAVSWVTFHSAYDFGYLVKALTRRELPGDLPEFLAVVRVFFGDRVYDVKHLMRFCHSLHGGLDRVAAALELDRAVGKCHQAGSDSLLTWQAFRKIRDVYFANDDGPEKHAGVLYGLEVY

SEQ ID NO: 748 - protein, 31 aa, Eucalyptus grandis
MATGVEGNEGVPANLRKQLAVAVRSIQWSYA

SEQ ID NO: 749 - protein, 229 aa, Eucalyptus grandis
MNHFFSSYSDPSSCSLDFAEASSSSSPLSDGRSAMVPGNFSDEEVLLASHQPKKRAGRKKFQETRHPVYRGVRRRSSGKWVCEVREPNKKSRIWLGTFPTAEMAARAHDVAALALRGRSACLNFADSAWRLPAPASADAKDIQQAAAQAAEAFRPAESEAEDVMSGYEKKSPSEEGMLYDDEDVFGMPGLLTNMAEGMLLPPPQCGGDGYGGEDDGNLDAYVSLWNYSM

SEQ ID NO: 750 - protein, 210 aa, Eucalyptus grandis
MPIRIQNLPKKNFDQGSSLSMPHVGVTYPPWWSLNEQQLPQSLPKNSGLKAESPPMLHHQAKHLGLQLQEQESSSTQSAGNSCHEVSVVGGANSQDQSISSESGQDESCGRSFEGQTKPIFMFNNPEIVFNSSLADQNQPLIRVPYPPVDPYYGGLLTAYRPQAIIQSQVGSQMFGMAPGRVPLPLNLADHGPIYVNAKQYSRNSSEEAV

SEQ ID NO: 751 - protein, 93 aa, Eucalyptus grandis
GYGFVRFGDETEQLRAMTEMNGMYCSSRPMRIGPAANKKPIATQQYQSASYQNSQGNQGENDPNNTTIFVGGLDPSVSDDLLRQVFSQYGELH

SEQ ID NO: 752 - protein, 97 aa, Eucalyptus grandis
GYRRSAKKCKEKFENVHKYYKRTKEGRAGRQDGKTYKFFSELEALHNTAAGATVGISSSFKWWWCCFWHCSPGRSLGTPSFDRDIVRQPRPNLHCPR

SEQ ID NO: 753 - protein, 241 aa, Eucalyptus grandis
MEMEDHHQYTAADLRHLINARPPPPPPHIQSISPPELFCGGGGHRNPTQHLESMMMGGGGLHNGQRQGHSHNHQHHHQFGRDHSSPSSVAMAGAAGGLESENGGNGRWPRQETLTLLEIRSRLDSRFKEANQKGPLWDEVSRIMSEEHGYQRSGKKCREKFENLYKYYKKTKEGKAGRQDGKHYRFFRQLEALYGENANSNSILQAPSLPHSLHFHPPPNINDINQDASHHRHPHQLQRPC

SEQ ID NO: 754 - protein, 104 aa, Eucalyptus grandis
MERGDPNVVAVARLRREDCERTKHDSAFATWKVLVGPTDWEDYSLGKEGAARYRVHNLPKSPGPGIYELGVAASHAKLGREIAKLDPRYIVVVYLGKADCVRTR

SEQ ID NO: 755 - protein, 229 aa, Eucalyptus grandis
MGYAQLVIGPAGSGKSTYCSSLYQHCEAIGRTIHIVNLDPAAENFDYPVAMDIRELISLDDVMEELGLGPNGGLMYCMEHLEENLDDWLTEELDNYLDDDYLVFDCPGQIELFSHVPVLRNFVEHLQRKNFNVCGVYLLDSQFITDVTKFISGCMASLSAMVQLELPHVNILSKMDLVKNKRDIDDYLNPEPRVLLSELNQTMAPKFEKLNKALAELVDEYSMVSFIPL

SEQ ID NO: 756 - protein, 81 aa, Eucalyptus grandis
YPTIIYRPYSFMAKISAVERGHFLTVIPHFAWRLVNPATLKYFDAPHRPMYMQEYLYSIRNHRYTATMLQHIAEDRDGTSH

SEQ ID NO: 757 - protein, 115 aa, Eucalyptus grandis
MPKGSSIKMGVPLQHSSGIKQLNVHFQERDLCSTQSTSQSFSEVPNIGGSTDCSQATVLEQTEHGETEGQSVRGQAKSALSMGTQDLVFQPLEVCIPLHYAEPSLGGFMPAAYGP

SEQ ID NO: 758 - protein, 356 aa, Eucalyptus grandis
MKERQRWRAEEDALLRAYVKQYGPREWHLVSQRMNTPLNRDAKSCLERWKNYLKPGIKKGSLSEEEQRLVIQLQAKHGNKWKKIAAEIPGRTAKRLGKWWEVFKEKQQREQKENKGALPIDEGKYDHILENFAEKLVKERSTPALLMATANGGFIHTDSPALAPTLLPPWLSNSNGTPTLRPPSPSVTLSLSPATVPASQPIPWLQADRGLDSGSLSLTGLPNHGPLPTSGENILMSELAECCKELEEGHRAWAAHKKEAAWRLKRLELQLESEKACRRREKMEEIEAKINTLREEQKASLDKIETEYREQLAGLRKDAESKEQKLAEQWTAKHVQLSKLIEQIGFRPRIADHDRQ

SEQ ID NO: 759 - protein, 93 aa, Eucalyptus grandis
GLDSCSVEELQQTENQLERSLTKIRARKNHLIREHIERLKAEERKLLEEKRKLLQEIECGKGLTPVSSEPPREEIRAESMDVETELFIGPPKR

SEQ ID NO: 760 - protein, 70 aa, Eucalyptus grandis
EDPVGRPESASEISQEPGQEFMDEDELLNMPKLLDDMAEGMLVSPPRTQMASENDSPEDSDGGESLWSYP

SEQ ID NO: 761 - protein, 243 aa, Eucalyptus grandis
MCGGAIISDFVEERLDRRRPGSCRPERKLTPHELWSELDPASDLLSLDGPVAQGHPNPFSLVANQLNQVMKSEEKNSEEAGHGHVSETQKSQSNGRSQRARKNVYRGIRQRPWGKWAAEIRDPHKGVRVWLGTFKTAEEAARAYDEAAKRIRGDKAKLNFSGPPAPAQPSAKKRCVAPDEPKDEAGAAGCELKERIASLESFLELEPTEEPLEPGTGPSPADLWMLEDLVTHHQHRFDNQLVY

SEQ ID NO: 762 - protein, 125 aa, Eucalyptus grandis
QQRLLQYWSDALNLSPRGRMMMMNRLGPDGRPIFRPPQPINTTKLYRGVRQRHWGKWVAEIRLPRNRTRLWLGTFDTAEDAALAYDREAFKLRGENARLNFPELFLNKDKAEESAGPSSSSSSPP

SEQ ID NO: 763 - protein, 141 aa, Eucalyptus grandis
SIPSVGLLVQYKLLNPASSYSSCIMIQDMSQGFRKIDTDRWEFANRGFQEGKKHLLKNIRRRRKLSDHRTTSSSTVASDYPEAGKEAELEMLKRDQEALKAEILKLREERENSQHEINQVIERFRYAECRCRRMFLFLSKA

SEQ ID NO: 764 - protein, 202 aa, Eucalyptus grandis
KHLLNNIYRRKPIHSHSGQGARLSDSEKQMYEEEIKRLRHEKSSLQLELQRYQGDNQDVDFQIQLLRKQFQNMEQKQTHLITVLAQLMQKPVFASLFTQQSDSPTKKRRLAELDHLHDSDDKSGLESLKFQKEKFNGVPFSLLDLDSVEKLEQSLHFLENLLQGVDNTSGAEQHDFGAISLPWPAGFTERKESLDDSDRHIH

SEQ ID NO: 765 - protein, 175 aa, Eucalyptus grandis
MQPKSKISNGVDAHPHSIQTSAVFTEPWWRGYNTISPADPGRNETHAPLGCINGGSESNGGQSQSNEERVEEDDDDDNVKGSGNPACSGAVGNQGQGPQNGHGAPTIITMRDDGLAQPPQLELVGHTIACASNPYQDPYYGGLMAQYGHQSMAYPFVGIPHARMPLPLDLAQEPC

SEQ ID NO: 766 - protein, 190 aa, Eucalyptus grandis
TGANEKDSVMEITFHVPNSNTQFVGDENRPPAQVFRDRIMSVADVGAGGEDAVVTFEGIAILTPRGRYSVELHLSFLRLQGQANDFKIQYSSVVRLFLLPKSNQPHTFVIITLDPPIRKGQTLYPHIVMQFETDYVVQSTLSMNDDLFNTKYKDKLEPSYKGLIHEVFTTILRGLSGAKVTKPGKFRSSQ

SEQ ID NO: 767 - protein, 251 aa, Eucalyptus grandis
LETSGNRLARAISDADTSSAAALMDMLEQMVSVMGDPIQRLGAYLLEGLRAKLKFSGSIIYRKLKCEEPTSSELLTNMQVLYQICPYWKFAYVSTNVIITKAMENEQRIHIVDFQITQGSQWVTFIQALAQRPGGPPLLRITGIDDSDSVHARGAGLEIVGQKLSEIAESCNVPFEFHDAAVSLSEVELQNLMIRPGDALAVNCPYILHHIPDESVSTQNHRDRVLRLIKSLSPRVVTLVEQESNTNTSSF

SEQ ID NO: 768 - protein, 174 aa, Eucalyptus grandis
GNWDEPTKEEVNEPADIAEAKTVSDSEEAKPNAKRKQPEKEASEKEASKKEPNKPPNSWFDLKVNTHVYVTGLPEDVTMEEVVEVFSKCGILKEDPETKKPRVKIYVDKETGRKKGDALVTYLKEPSVALAIQILDGAPFRPGGKVPMSVSQAKFEQKGDKFISKQVDGKKKRN

SEQ ID NO: 769 - protein, 218 aa, Eucalyptus grandis
TFEQLLLPFLYELQILIDLSNDKATVLTDKIQVLKDLTTEVNKLKAECAALIEESREEKNELREEKSSLKSEVENLNVQYQQRTRVMYPWAAMDPSVVMGPAYSYPGPIPVTPGPIPMLSQLQPFPFFGNQNASAIPAPCSTFIPNSMPANPTFEQQSTQYASTSHVSNKKDSKSRSSDHQRGSIAEQDEDSNNVATDLELKMPGTSSHQDLTSGEKK

SEQ ID NO: 770 - protein, 188 aa, Eucalyptus grandis
HPMKPESVEVLNFGDSGSGRLLSSHSQVAVAEEPLNHVEAERQRREKLNQRFYALRAVVPNVSKMDKASLLQDAESYIRELNMNLQAAESDKEDLKKQLDELKKRSSDKECIPVDQDRKMAKPTGSRSTGVAIDVKIMGWDAVVRVESGRKDHPAARLMVALQELNLELQHASVSVVNELMIQQATVK

SEQ ID NO: 771 - protein, 157 aa, Eucalyptus grandis
MMLGEPHRPPNPTIDVPPWPILDDPTDDAVPHSPYSPYTLNAGYGGGCDSSPSAAGPGHFQDVMAALRRFLPSNRPDTDPDPDMTSSREADFPMDVYSCDNFRMYEFKVRRCARGRSHDWTECPYAHPGEKARRRDPRKYHYSGTACPEFRKGSCRK

SEQ ID NO: 772 - protein, 129 aa, Eucalyptus grandis
DEPSTSATNSGGGAAAASSSGGGRSHECSICHKSFPTGQALGGHKRCHYDGGASGSANSGVTTSEGVGSAAPPALGYDSGRRNFDLNVPALPEFPTGFIVSGDDEVESPHPSKKPRFSTPLKIKLSPEQ

SEQ ID NO: 773 - protein, 149 aa, Eucalyptus grandis
MAFEQYFAQEWRPIPGPAMDSGSSDGCFDCNICLDFAIEPVVTLCGHLYCWPCIYKWLHVQSASLASDEHPQCPVCKAEISHTAMVPLYGRGQSSKESDLQDKALQLGTIVPPRPAACGIQALASTTPRSGQQLPYRNPYQNPYYSANS

SEQ ID NO: 774 - protein, 175 aa, Eucalyptus grandis
MVKRDREDTEVEALARANCLMLLSRVGESTDSASPDRKSRPTERMFACKTCNREFSSFQALGGHKASHKKPKLISGDLFHLGHAADSSPAKPKTHECSICGLDFPMGQALGGHMRRHRAAMLESLAAAAAKPVPVLKKSNSKRVTGLDLNSLPMEDDLTLRLGKVAPPLVLDLVL

SEQ ID NO: 775 - protein, 154 aa, Eucalyptus grandis
PDAAGERLGHGDQEEPLGVGGVGLPGRAYFSSNPAWVTGAERLGNCGCDRARQAQIFGLQTIACVPVLNGVVELGSTEPIYQSSDLISGIRGLFNFHESEMGCGGRVLNSEHDPASLWICDPPVTMEINDRPMTFQIENPSSSSLTESPSAICA

SEQ ID NO: 776 - protein, 177 aa, Eucalyptus grandis
LGTQIPSGIHMPSANLSSISILGPIPMVSGDGGGRTGSERSRNADCAPAGFPGGDEDVNKGGDIPYGMSTIVRVIPNSRYLRVAQQLLDEIVNVRKALKRPDDANDQSRHENQRSPKDADGGSKNEASSNPQESASNSSELSAAEKQDLQNKLTKLLSMLDEVDKRYKQYYHQMQIV

SEQ ID NO: 777 - protein, 59 aa, Eucalyptus grandis
GNEVSSDYGWKFLFAGLQRCGKSCRLRWLNYLRPDIKRGNISPDEEELIIRLHKLLGNR

SEQ ID NO: 778 - protein, 175 aa, Eucalyptus grandis
MHHPPNPDSLSLLQSARTPNAPPEHPVPSTSRRDEVAVLKSQKAGREKLRRDRLNEHFIELGNTLDPDRPKNDKATILSDTVQLLKDLTAQVNQLKAEYSTFCEESRELTQEKNDLKEEKASLKSDIESLNAQYQQRARAMFPWPIMDHSVVMAPPSYPYPVPVAVPSGPIPVHP

SEQ ID NO: 779 - protein, 162 aa, Eucalyptus grandis
MNVEKLMKMAGSVRTGGKGTMRRKKKAVHKTTTTDDKRLQSTLKRIGVNAIPAIEEVNIFKDDVVIQFVNPKVQASIAANTWVVSGAPQTKKLQDILPGIINQLGPDNLDNLRKLAEQFQKQSPGAAATAGATAMQEDDDDEVPELVPGETFEAAAEEGHKS

SEQ ID NO: 780 - protein, 151 aa, Eucalyptus grandis
MGEPIFLPGRTSLVGSISVNVVGIQHNAGTFRAGETVALVREPSNTDDEMAIQVLNTRGMVVGYIKREAAKVLAPLIDSQLISVYAIVPKVPRVEKLFFINCQVRVLARDDDFEHVKSTILEGKLMLTPPVGKEVRGVNESFTLVGQGVEK

SEQ ID NO: 781 - protein, 611 aa, Eucalyptus grandis
MMMFEDMGICGDLDFFSAPLGEGHGVAPQTEPEATVEDDYSDEEIDVDELERRMWRDKMRLKRLKEQNKGKEGVDIAKQRQSQEQARRKKMSRAQDGILKYMLKMMEVCKAQGFVYGIIPEKGKPVTGASDNLREWWKDKVRFDRNGPAAIAKYQADHSVPGKNDGCNPIGPTPHTLQELQDTTLGSLLSALMQHCDPPQRRFPLEKGVPPPWWPTGNEDWWPQLGLPKDQGAPPYKKPHDLKKAWKVGVLTAVIKHMSPDIAKIRKLVRQSKCLQDKMTAKESATWLAIINQEESLARELYPDSCLPLSSSGGSGSLVINDCSEYDVEGMEDEPNYDVQERKPENLNPPSHLGLERMRGPFVQQSPFQMKGEVVSNLDMARKRKPCNDLNMVMDHKIFTCEFLQCPYSELRLGFRDRTSRDNHQLSCPYRSNSSEFGGSNFHVNEVKPVIFPQGFVQSKPMTSTVNSASTPFDLSGLGVPEDGQKVISDLMSIYDTSIQGNKNMNPANDAIIEDQSRPQPKLQQQNEFVGSFFQQPNASANHHMFSREDIQFDRFKTMNSSFEANNHNHDNLQLMFGSPFDLSSFDFKEELPGGVMDPLPKQDVTIWFQQ

SEQ ID NO: 782 - protein, 133 aa, Eucalyptus grandis
MVKRDREDTEVEALALANCLMLLSRVGKSTDSPWLNHKSRPTERMFACKTCNREFSSFQALGGHRASHKKPKLSGDLFHLGRSADSSPAKPKTHECAICGLEFPLGQALGGHMRRHRAAMAESLATAEKPVPV

SEQ ID NO: 783 - protein, 145 aa, Eucalyptus grandis
MVMDISNDDRYLNEEIGGPKDALDDGTQPNNKRKRGRAPKRAMKAEREKLKRDHLNELFDKLGSLLELSEPNNGKASIINETIRLLKDMISQIQSLRKENTTLLSESHYVAAETNELKDENFALEAQIKNVQRELEDKLGHSKPD

SEQ ID NO: 784 - protein, 322 aa, Eucalyptus grandis
ECLPLLDMTQQPPWQELVATDLHGNEWHFRHIFRGQPRRHLLTTGWSVFVSSKKLIAGDAFIFLRGEDGELRVGVRRLMRQQSNMPSSVISSHSMHLGVLATASHAIATGTLFSVFYKPRTSRSEFIVSLNKYLEARAHKLSIGMRFKMKFEGEEVSERRFSGTIIGVGDSMSSGWTNSEWRSLKVQWDEPSSIMRPDRVSSWELEPLVVTAPSNSQQVQRKRARPTVLPSSSVQELSAFGGPKAPEYSSDFLHGDSQRGRDVYLSPKFSPSARSKSLNYNGNGSPAALSGYTVNWPSHMETITDPCTPVNGKESSEKRESG

SEQ ID NO: 785 - protein, 50 aa, Eucalyptus grandis
MASQFNFKGITDASQAEGVAGKSHGNHSLTRQPSIYALTFDEFQNTWGGL

SEQ ID NO: 786 - protein, 152 aa, Eucalyptus grandis
ETSPSSSSLTTTTAPAPAAAAAAATTSSSSYSSAVAVAATTATTSSSSTSSTGSDPALEPSKRSEDCTSQKGPGKSPSPGAHPEEPAGKRHKAGGSGEHPTYRGVRMRNWGKWVSEIREPRKKSRIWLGTYPTAEMAARAHDVAALAIKGSF

SEQ ID NO: 787 - protein, 148 aa, Eucalyptus grandis
MFPRPKVDPASAGTVVIREVWAHNLESEFDLIRDVVDTHPFISMDTEFPGVVFRPPPPPSAGGHYRRLRPSDHYRLLKSNVDALSLIQVGLTFSDPDGNLPDLGCPGGPRYIWEFNFRDFDVARDAHAPDSIELLRRQGIDFERNRAE

SEQ ID NO: 788 - protein, 248 aa, Eucalyptus grandis
KPSERRGGPRGPFRGSGGRRGGFNNGEAGEGERPRRTFERRSGTGRGNEFKRDGAGRGNWGTPTDEIAPEPEEPVVEVEKNVGSEKQLVDEEAADASKENPLNEPEEKEPEDKEMTLEEYEKVREEKRKALLALKAEERKVEVDKELKSMQQLSSKKENHDIFIKLGSEKDKRKEAAEKEERAEKSVSINEFLKPAEGERYYNPGGRGRGRGRGARGGYGGGGGGGYGRDAAAPSIKDPGQFPSLGGK

SEQ ID NO: 789 - protein, 55 aa, Eucalyptus grandis
MSFTGTQVKCKACEKTVYPVEQLSADGVAYHKSCFKCSHCKGTLKVCQFFQLVYN

SEQ ID NO: 790 - protein, 148 aa, Eucalyptus grandis
MIDLNTVEDDETPSSGSSPASSLSSAISASNINSNPAYPTSSSSSSSSCSPLCLELWHACAGPLISLPKRGSLVVYFPQGHLEHVSDFPTSVFDLPSQIFCRVVDVKLHADASTDDVYAQVSLVPEREQIEHKLREGDNEIDLDEDEI

SEQ ID NO: 791 - protein, 106 aa, Eucalyptus grandis
MASHPSNHSCGRPHQGAFADALYKELWHACAGPLVTLPREGERVYYFPQGHMEQLEASTNRGLEQQMPSFDLPSKILCRVVNIQLRAEPETDEVYSQITLLPEPEQ

SEQ ID NO: 792 - protein, 82 aa, Eucalyptus grandis
EQYLNLAYVQQLENSRFRLMQLEQELQRARQQGIFVSSGNPGDLSHNMAAIGNGAMAFDTDYARWLDEHQRLINDLRSGVNF

SEQ ID NO: 793 - protein, 247 aa, Eucalyptus grandis
FFLYIISLFLVRENSERSREGTSSNGDGKSEVQGKVAGEVDAASENVSGGAIERPRATGKLAAPVNSPSMSSSLDLKNSCMDANANPVSILQPGVVPPEAWLQNERELKRERRKQSNRESARRSRLRKQAETEELAKKVDSLSAENRALKSEISQLTENSDKLRLENATLMERLENAQGVEKAVESLGKFNDNGLLSDKTENLLSRVNNSGAVDRRSEDEGEIYERKSNSGAKLHQLLDSKPRTDAV

SEQ ID NO: 794 - protein, 145 aa, Eucalyptus grandis
FSLSPHHLKMEVAPQAEHHQNHHHHHHQYHHQPQQGEPGSYFLSAPPPPPHYSSSGLCYGGGVGDNNNGGYLHSPLSVMPLKSDGSLCIMEALTRSRPQGLGQGSTPKLEDFLGGASATVTATTMPLSLDSLYSYQQSADPEKQS

SEQ ID NO: 795 - protein, 220 aa, Eucalyptus grandis
ETQREKVERERETSIPSQSPQPTILPPTASSPGRSDPPGDATTMVKPSGGGGDRAPPLAPFLSKCYEMVEDEATDPIIAWGSAGDTFVIWDITQFTLQLLPHYFKHSNFSSFMRQLNIYGFRKVDSDRWEFANDGFIRGQKHMLKNIRRRKNVQVVDQKKSLQKQDNSVEEVDKIKIDGLWKEVENLKIDKTVLSLELGKVRQLQETSDNKLVLLRDRVQ

SEQ ID NO: 796 - protein, 212 aa, Eucalyptus grandis
MIGAATNQIPPPPPPPQPQQAAPAAAAIRFPDSVYNALRVGAVFQRLSKHLATIGKGSGLSASCGTSMEFLNSCLCLARGIDYAVANNEVLPKAHELPVLLKRLCLLKDDSFYLSVIMVLMISVKNACKYKWFSEKDCQELLALVDEIGKNFQSPRDAAVGSTASFSRVSSIFARFYPQLKMGYDLISLEVEPGYAALVNDFHISKSMVHSP

SEQ ID NO: 797 - protein, 269 aa, Eucalyptus grandis
MNSTTTQFVSSRRMGMYDPIHQIGMWDENFKQNGNPNAPPALIIPMHANLDNQSEDTSHGSQDTAGKYEQETSKPYDKVQRRLAQNREAARKSRLRKKAYVQQLEASRLKLMQLEQEVDRARQQGVYMASGVDSAYPGYGGCLNSGIVAFEMEYGHWIDEQNRQICELRAALNDHRTDVELRILVESGMNHYLELFRMKAVASKADVFYVMSGMWRTSSERFFLWIGGFRPSELLKVLMPQLDPLSDQQWAFVSNLRQACQQAEDALKQ

SEQ ID NO: 798 - protein, 145 aa, Eucalyptus grandis
INTTPQFLSLRSHPNRHPQSLSFSLFFSVCPVCDKGFPSYQALGGHKASHRKHASSAAAAAGGDDQPTTSSTSAATTSSGVSGKVHECSICHKSFPTGQALGGHKRCHYEAPAPIPASFSAPSAAAAPAASGVSVSEGVGSTHTQ

SEQ ID NO: 799 - protein, 121 aa, Eucalyptus grandis
RHHKIQQLQRARSELARMFSLEGQLEDPVRSGWQLVFVDRENDSLLLGDGPWPEFVNSVWCIKILSPQEVQQMGKQDLELLNSIPVQRHSNGGCDEFTNRQDSRTINSGIPSVGSLDYGTL

SEQ ID NO: 800 - protein, 182 aa, Eucalyptus grandis
TDDTGDKNHRFEGGQLGVAAASDSSDRSKEKATDQKTLRRLAQNREAARKSRLRKKAYVQQLESSRLKLTQLEQELQRARQQGIFISGSGEQSHSMSGNGALAFDVEYARWLEEHNKVVNELRNAVNAHAGDTELRTIVDNVAAHFDEIFKLKGTAAKADVFHILSGMWKTPAERCFMWIGG

SEQ ID NO: 801 - protein, 74 aa, Eucalyptus grandis
MSFTGTQVKCKACEKTVYPVEQLSADGVAYHKSCFKCSHCKGTLKLSSYSSMEGVLYCKPHFEQLFKETGNFNK

SEQ ID NO: 802 - protein, 194 aa, Eucalyptus grandis
KSVFHVFYSPRASHAEFVVPYQKYLKSINNVICIGTRFKMRVDVDDAPEKRCTGVVTRIGDLDPYRWPNSKWRCLMVQWDDDITNGHQDRVSPWEIDPSVSHSPLSIQSSPRLKRPRTSLPTMPPVPGGGVRLLDFEESLRSSKVLQGQEKLHLVSPVYGRDTLNCQVDFEQSPAHQGLASVVSKKRPTISMST

SEQ ID NO: 803 - protein, 282 aa, Eucalyptus grandis
RRANRPQTVMPSSVLSSDSMHIGLLAAAAHAAATNSRFTIFYNPRASPSEFVIPLAKYVKAVYHTRVSVGMRFRMLFETEESSVRRYMGTITGISDLDPVRWQNSHWRSVKVGWDESTAGERQPRVSLWEIEPLTTFPMYPSPFPLRLKRPWPSGLPSFHALRDGDMSISSSLMWLQGVGDQGVQSLNFQGFGMTPWLQPRYDTSMAALQTDVYQAMASAALQDMRAVDPSKCASQSLLPLQQSQNVPMGQASIIQRQMLQQSQSQNSLLQGFQENQAKPKG

SEQ ID NO: 804 - protein, 177 aa, Eucalyptus grandis
DKLREIENSLFGPESDISDSCNCCLNSGSHQFPSTGQWNVNQMIEMIPKLDLKDMLIVCAQAVAEADMPRTAALMEVLERMVSVSGDPIQRLGAYLLEGLRARLESSGSIIYRKLKCKEPTGSELMSYMSILYQICPYWKFAYESANVVIGEAIKYESRIHIIDFQIAQGSQWIPII

SEQ ID NO: 805 - protein, 86 aa, Eucalyptus grandis
MGRSPRCDKDGLNKGAWTAAEDQILMDYVKLHGEGKWSRLSRETGLRRCGKSCRLRWMNYLRPDIKRGNISPDEEELIIRLHKLLG

SEQ ID NO: 806 - protein, 133 aa, Eucalyptus grandis
MRLSSSGFNHQSPEASNAGEKKCLNSELWHACAGPLVSLPPVGSRVVYFPQGHSEQVAASTNKEVDAHIPNYPNLSPQLICQLHNVTMHADVETDEVYAQMTLQPLSPQEQKDLYLLPAELGTPSKQPTNYFC

SEQ ID NO: 807 - protein, 222 aa, Eucalyptus grandis
SPFLSLTTSSSSSPPRRKIRTLGRAANRRNPSPAEVAAAAVHAYLSRRRPAERILLRSGPMSPARSKPIAIRAVFYANLESEFALIRSVVDRFPIISMDTEFPGTVIRPGPAGGGGGRALPPPESNYGLLKANVDRMHMIQIGLTLSDGEGNLPDFGTKCAYIWEFNFRDFDAARDVQNPDSVALLRKQGIDFEMNRQKGADSARFGELLMSSGLVCNDEVS

SEQ ID NO: 808 - protein, 111 aa, Eucalyptus grandis
RGGFNMEKLARGSVQEEHLNAAVALDEGWYCTPRMLHFSFENEFKRDGAGRGNWGTPTDEIAPEPEEPVVEVEKNVGSEKQLVDEEAADASKENPLNEPEEKEPEDKEMTL

SEQ ID NO: 809 - protein, 159 aa, Eucalyptus grandis
QSGLPLDDRPEGARSPSPEPIYDNMGIRINTREYRARERLNKERQDIITQIIKRNPAFKPPADYRPPKLQKKLYIPMKEYPGYNFIGLIIGPRGNTQKRMERETGAKIVIRGKGSVKEGRLQQKRDLKPDPAENEDLHVLVEAETQEALDAAAGMVEKL

SEQ ID NO: 810 - protein, 387 aa, Eucalyptus grandis
MCGGAIISDFIPNQRARRLTSDFLWPDLKRSAGKQSRRPARSEVVDVVDDDFEADFQGFKDESDVEDDFDDEVEVDVKPFAFSAAEPRYSKGSSTTKSVEYNGQAEKSAKRKRKNQYRGIRQRPWGKWAAEIRDPRKGVRVWLGTFNTAEEAARAYDAEARRIRGKKAKVNFPDDSSSASSKRSVKSNVQKLPKTTTNNVQPNLNQNFNYANSSDDDIYSSMGFVEEKPPTNQFYMDALNAQGVSGMNSLSPADNAPLYFNSDQGSNSFECSDFGWGENAPRTPDVSSVLSATLEVDESQFEDANPRKKIRSASDDVSEEENTAAKTFSEELSAFESDMKFFQMPFVDGGWDPSVEALLGGEATQDGGNAVDLWSFDDLAPMMGGVF

SEQ ID NO: 811 - protein, 219 aa, Eucalyptus grandis
HGGAAGFLGPRAVPMKQAGLAQKPTKLYRGVRQRHWGKWVAEIRLPKNRTRLWLGTFDTAEEAALAYDKAAYRLRGDFARLNFPHLKHKGSHIQGDFGDYKPLHSSVDAKLQAICQDMAEKPADGKKRRSAPAGGGSSAAAASPRRPEPEPEPVKTEVGVSAATSSSPESDDASVEESSPLSELTFNDFVEPQWESVGVPENFSLQKYPSEIDWAAIYS

SEQ ID NO: 812 - protein, 75 aa, Eucalyptus grandis
MKERQRWRAEEDALLRAYVKQYGPREWHLVSQRMNTPLNRDAKSCLERWKNYLKPGIKKGSLSEEEQRLVFHLLP

SEQ ID NO: 813 - protein, 235 aa, Eucalyptus grandis
VVLPSSGMVKSSGGAGDSDHSDLEASVVKEADSSRVVEPEKRPRKRGRKPANGREEPLNHVEAERQRREKLNQRFYALRAVVPNVSKMDKASLLGDAIAYIKELNSKLQTTESDKENLQKQMESLKKELTNKDSRSALPQSDKDLSISSNHGAKLIELDVDVKIIGWDVMIRIQSSKKNHPAAKLMQALMELDLDVHHASVSVVNDLMIQQATVKMSGRFYSQEQLRLALSSKIG

SEQ ID NO: 814 - protein, 111 aa, Eucalyptus grandis
ELKPDKIGLQRSEQLRDLYESLLEGETDAQNKRPSAALSPEDLTDEEWYYLVCMSFVFNPGEGLPGRALADGQTIWLCNAQYADSKVFSRSLLAKSASIQTVVCFPYLGGV

SEQ ID NO: 815 - protein, 107 aa, Eucalyptus grandis
MESERYDETTEKQRIRRRPHQKPYRGIRMRKWGKWVAEIREPNKRSRIWLGSYATAVAAARAYDTAVFYLRGPSARLNFPDLILHEGQDSLGEVSAASIRRRAAEVG

SEQ ID NO: 816 - protein, 89 aa, Eucalyptus grandis
MAFTGTVDKCKVCDKTVHVVDMMTLEGIPYHKTCFRCSHCNGTLVMSNYSSMDGVLYCKTHFEQLFKESGDFRKNFHSAKSDKPNEMTR

SEQ ID NO: 817 - protein, 96 aa, Eucalyptus grandis
MESERYDETTEGQRIKRRPHQQQQQQQQRRQKPYRGIRMRKWGKWVAEIREPNKRSRIWLGSYATPVAAARAYDTAVFYLRGPSARLNFPDLIWRE

SEQ ID NO: 818 - protein, 159 aa, Eucalyptus grandis
MVKRDREDAEVEALAVANCLMLLPRVGESAVSNRESRSTERMFACKTCNREFSSFQALGGHRTSHKKQKLIPGGLFHLGCTADSSPAKPKRHECSICGLEFPMGQALGGHMRRHRAAMAEGLAAEAAKPVPVLKRSNSKRVMCLDLNSSLMEDDLTLRL

SEQ ID NO: 819 - protein, 241 aa, Eucalyptus grandis
EDSLDKEPPPPPPPRFKVHSFCKTLTASDTSTHGGFSVLRRHADECLPQLDMSKQPPTQELAAKDLHGNEWRFRHIFRGQPRRHLLQSGWSVFVSSKRLVAGDAFIFLRGENGELRVGVRRAMKQQGNVSPSVISSHSMHLGVLATAWHAISTGTMFTVYYKPRISPAEFIIPYDQYMESLKKNYSIGMRFKMRFEGEEAPEQRFTGTIIGIEDADPKGWRDTKWRSLKVRWDENSAIPRP

SEQ ID NO: 820 - protein, 185 aa, Eucalyptus grandis
FRGVRKRKWGRWVSEIRLPNSRERIWLGSYDTPEKAARAFDAAAFCLGRPAAKLNFPGSPPEISGAASLSPDEIQSAAASHANFGAVAVPARAELPRPGSPAPSPSLSASEASSVLTTESDLTLDLSFLDFLDDSGPVSGEPHIGKFPGVEEAPDVFYHMQFPSVESAGLNLDTLLASDSFPWRI

SEQ ID NO: 821 - protein, 187 aa, Eucalyptus grandis
EADFLAKHSKPEIVDMLRKHTYRDELEQSKRSYRGSAAERAGRGGFGPGRTEWSAAAREQLFEKAVTPSDVGKLNRLVIPKQHAEKHFPLPGGPAATMKGVLLNFEDVGGKVWRFRYSYWNSSQSYVLTKGWSRFVKEKSLKAGDTVCFQRSTGPDKQLYIDFKPRGQPPAGPAAPPPPPVQMVRLF

SEQ ID NO: 822 - protein, 110 aa, Eucalyptus grandis
VNPPTRTFVKVHKSGTFGRSLDISKFSSYDELRSELARMFGLEGQLEDPQRSGWQLVFVDRENDILLLGDDPWQEFVNNVWYIKILSPHEVKQLGKQGINPANSVPRQAL

SEQ ID NO: 823 - protein, 370 aa, Eucalyptus grandis
MTRRCSHCCNKGHNSRTCPVRGGGGDGGGAAAAPSSSSPSTSSSGAAAAAAASASGGGVKLFGVRLTDGSIMKKSASVGCLSAAHYHSSSSAAASPNPGSSPIDGSDGYLSDDPAPGSRSSNRRVERKKGNPWTEEEHRRFLIGLQKLGKGDWRGIARDFVTTRTPTQVASHAQKYYIRQSNAGRRKRRSSLFDMAPDMATADQPSHPEETFLPPLVRLNDDTNSTTSTSMGLDLERTPMETSHPETSEGGGDVAMESIDQVPLVPCYFPYYLPLPFPMWPPNMAPPEDGRVVETSHHRVLKPIPVIPKEPLNIDQIVGMSQLSLAENEPAPLSLKFLGETSRQSAFIKAPSSVNESDLDNCKDGATQAA

SEQ ID NO: 824 - protein, 160 aa, Eucalyptus grandis
ELWLSFGTGEKKSINSELWHACAGPLVSLPPVGSLVVYFPQGHSEQVAASMQKETTCVPSYPNLPAKLICMLHNVTLHADLETDEVYAQMTLQPVSKYDQEALLASDMGLKQSRQPTEFFCKTLTASDTSTHGGFSVPRRAAEKIFPSLDFTMQPPCQEL

SEQ ID NO: 825 - protein, 129 aa, Eucalyptus grandis
MALEALNSPTAAAPFGHDDADGHPWAKRKRSKRPRADPQDQPSEEEYLALCLIMLARRRRRPGSSGRLHECSICHKAFPTGQALGGHKRCHYDGGSSSSAARAASSSEAGGPSHTTVSHREPIDLNLPA

SEQ ID NO: 826 - protein, 115 aa, Eucalyptus grandis
RHLLQSGWSLFVSSKKLVAGDAFIYLRGENGELRVGVRRAMRQLNNVPSSIMPSHSMHIGVLATAWHAISTGTMFTVYYKPRTSPAEFIIPFDKHIESAKFDYSIGMRFRMTFEW

SEQ ID NO: 827 - protein, 199 aa, Eucalyptus grandis
SSVHDISENGEADEQQKHSEQHESSPATGVPHPGVSLPNVQYATPPQLGAGHAMTPPAYPYPDPYYRSIFAPYDAQSYPQQPYGAQPMVHLQLMGIQQAGVPLPSDAVEEPVFVNAKQYHGILRRRQSRAKAELENKALKSRKPYLHESRHLHALRRARGCGGRFLNAKKDENQQSEVSSADKSQGNINLNSDKSDRSS

SEQ ID NO: 828 - protein, 98 aa, Eucalyptus grandis
VKDMFQDQREKYDTFLEVMKDFKAQRTDTTGVIARVKELFKGHNKLILGFNTFLPKGFEISPDEDETPIKKNVEFEEAISFVNKIKKRFQNDEHVYKS

SEQ ID NO: 829 - protein, 136 aa, Eucalyptus grandis
MFRQHNLLLNFNPTDDDPQDEGSPPPPYVLRGAPPPAEPSPAEKEPMFEKPLTPSDVGKLNRLVIPKQHAEKHFPLVGEATQQLSFEDESGKWWRFRYSYWSSSQSYVLTKGWSRFVKDKRLDAGDVVLFTATAPT

SEQ ID NO: 830 - protein, 96 aa, Eucalyptus grandis
MAQRSAPAPFLTKTYQLVDDPATDDVISWGESGRTFVVWKTAEFAKDLLPSSFKHNNFSSFVRQLNTYGFRKIVPDKWEFANDRFQRGQKELLSEI

SEQ ID NO: 831 - protein, 81 aa, Eucalyptus grandis
RMWRDKMRLKRLKEQNKGKEGVDIAKQRQSQEQARRKKMSRAQDGILKYMLKMMVAHWKRGLVAPAGFAEGSRSPALQETS

SEQ ID NO: 832 - protein, 94 aa, Eucalyptus grandis
MDQWRTDLGASTSVHPQQHQHQHQHHPSSRLHASHDEPRQREEADVRDPVAARKVQKADREKLRRDRLNEHFLELGSTLDPDRPKNDKATILTD

SEQ ID NO: 833 - protein, 245 aa, Eucalyptus grandis
KKTISSEHKRRRVVVVVLLLLVPSTSFFPPPSSSLPPSLSLNLPNPSRRRRRERERERERREDHRFRPSRARAVMRRGRCAAAAAKREAAEIAPPPVPHAAAAAAAEPRYRGVRRKSLGRYTAEIRDPGTKKLVRLGTFGSPEEAARAFDAKAVAFRGVKARTNFPVAPSSFPPAASRDLRAPLIESRKFGRRGARDLRGDHHDVSPQRPTSSSLSSTVVSSSGPRPSPSPETAKRRTRTPPRHR

SEQ ID NO: 834 - protein, 180 aa, Eucalyptus grandis
YNSNSDPIREEFMKALEPFMKSVSPVSSPLSSLSSCDSVFPKQQPNLNPDLCSSWIVNPMGLEQSGSIGLNRLSHSQIQHIQDEMLLRRQNQELWLASAVKSPLQHEKFDQCRYQNHHGSPHLLRPKALSMKRVGVPPKPNKLYRGVRQRHWGKWVAEIRLPKNRTRLWLGTFDTAEEAA

SEQ ID NO: 835 - protein, 234 aa, Eucalyptus grandis
RERERGRGVMDLFFHEEVQSDIFWCDQLVEPPPPPPPPLPPANPSAFSPYTNRLPSQDRGFMPNPGNNMNKRVMEFLRRSWAEPSQIQEFDRERGFRHMLSERMRREKQKRSYSALLSELPHGTKNDKNSIVQTACMRIKELVKYKQELERQNGELKSGLNEKSGGDKAEGTKIRVKIANPTSGIDSMLEVLKCLDNMGLKATAIQTQCSADQLFAVIEVENEVCAQQSDANVH

SEQ ID NO: 836 - protein, 59 aa, Eucalyptus grandis
HGATWRRKEANGGSEASDAVLPRAHHRHRYKGVRMRKWGKWVAEIRQPNSRDRIWLGSY

SEQ ID NO: 837 - protein, 38 aa, Eucalyptus grandis
ELLQIQRKRKRMESNRESAKRSRLRKQQHLDELTTEVG

SEQ ID NO: 838 - protein, 167 aa, Eucalyptus grandis
MAPREKPSVAAIPNPNGAKEIRFRGVRKRPWGRYAAEIRDPGKKTRVWLGTFDTAEEAARAYDTAAREFRGAKAKTNFPTSAELISSSRSPSQSSSLDEPSPPPPAGAVQAAALGPPLDLSLGRHPVAAAAAGPGPYFPGAAAMCFPVMPPPPRPVFFFDPFGRMEH

SEQ ID NO: 839 - protein, 84 aa, Eucalyptus grandis
CLGLSSVAANAEKLAALQNEYHFAKARIDEDHEKAQRLEKKVKTLTFGYQMREKTLRDQIESTFKQLDTAGTELECFPALQKQE

SEQ ID NO: 840 - protein, 157 aa, Eucalyptus grandis
PSSPVSTKTHPPYLCTRPTRLSQGLRYRRLAAKHEEKPSAVLDKSQDPTDSAKPSKKPRHRHSPTQLAALNELFEKSEHPTLEERGQLAEKLGMETKTVNAWFQNKRASTKKRNKGGTSEPHPATSQNDLSEDALKTPSALPSIANLLNDAPSSASP

SEQ ID NO: 841 - protein, 86 aa, Eucalyptus grandis
YLHNPMRKRQRTLDMHAGAPGPNDAIDANSVGDNAFIADHDAIDSAGDDDDDEDKPKTGQKQGRRKIKIEFIQDKSRRHITFSKRK

SEQ ID NO: 842 - protein, 201 aa, Eucalyptus grandis
DHVPSSSALDSRSSSNRTSGVTLAEVLPTPGQSKSSADSGFCVSHLGGVPDSQSSSYAAEHVNTHQTQEIHLPVPQDNADLPDANFLVSETASPDYLETLSAALDGTMDVESDAFSSERDAGIMLDDVTNLPAISDVFWEQFLAASPLTADTEEISSTSHETGITNDQESHTKVENGFEKAHYMDHLTKQMGHLTSNNGTG

SEQ ID NO: 843 - protein, 187 aa, Eucalyptus grandis
FSTPPPHPESNPIPSLPPSLFFPQSFVAFSSTHAPQSPTPSIKLKHHHLKKKEGKKERRTGDPTEGRARTRHGTIPLLREGAHQQGRVDQGRGPAPHRLHPPPRRRLLALPPQICRASQVRQELQAQVDKLPPPRPQRGNFTEEEDELIIKLHSLLGNKWSLIAGRLPGRTDNEIKNYWNTHIKRKA

SEQ ID NO: 844 - protein, 112 aa, Eucalyptus grandis
MEMKGGVVPKEEEASSDVGQPPPPPPPPPQPMEGLGEAEAAPFLTKTFEIVEDPATDPIVSWSEGRNSFIVWDAHQFAVTLLPKHFKHGNFSSFIRQLNTYGVFDEYDTASF

SEQ ID NO: 845 - protein, 76 aa, Eucalyptus grandis
MTGNFGWGSNSMEEAWRKGPWTAEEDKLLIEYVKLHGEGRWNSVARLTGLKRNGKSCRLRWVNYLRPDLKRGQITP

SEQ ID NO: 846 - protein, 142 aa, Eucalyptus grandis
MNSNASSNPQSMATSTTSATTPAAGGDGGKKVRKPYTITKSRESWTEEEHDKFLEALQLFDRDWKKIEDFVGSKTVIQIRSHAQKYFLKVQKNGAVAHVPPPRPKRKAAHPYPQKASKNVLVPLQASMAQPSSTNPAFTITP

SEQ ID NO: 847 - protein, 84 aa, Eucalyptus grandis
MKMAERSNSSDPETSPSNSPSTSSSSSSYSPDPRRRAGSPAAARDPLRSSKRSKHPVYRGVRMRNWGKWVSEIREPRKKSRIWL

SEQ ID NO: 848 - protein, 60 aa, Eucalyptus grandis
KWRSRFRMAGFQQFPLSSAVTDAVRNLLREYNENYRIEEKDGALYLWWRNRAMATSSAWW

SEQ ID NO: 849 - protein, 90 aa, Eucalyptus grandis
GVGFPDPGPDNGQVLDARDPLAEKKLELATCQRRVEEEMLKHSKAVEVTRTSTLNNLQTGLPGVFQALASFSSLFMEVLDTVCTRSYAIK

SEQ ID NO: 850 - protein, 52 aa, Eucalyptus grandis
MAAPPAEQSGSASGGESQRSVPTPFLTKTYQLVDDPAIDAVISWNGDGSSFI

SEQ ID NO: 851 - protein, 52 aa, Eucalyptus grandis
MDPMDIVGKSKEDASLPKATMTKIIKEMLPPDVRVARDAQDLLIECCVEFIN

SEQ ID NO: 852 - protein, 121 aa, Eucalyptus grandis
MNSPLAQLVNPRRMHTYEPFDQFPMWGDTFKADKVKNLEASSSVIVHAVDDGLDKKFEYVSHESAENSSSRSDQEANRPDKVQRRLAQNREAARKSRLRKKKYVQQLESSRLKLAQLELEL

SEQ ID NO: 853 - protein, 293 aa, Eucalyptus grandis
FVYGIIPEKGKPVSGASDNLRAWWKEKVRFDRNGPAAIAKYRADHSIPGNGEDAATIGPIPHTLQELQDTTLGSLLSALMQHCNPPQRRFPLEKGVAPPWWPTGEEEWWPQLGLPADQGPPPYKKPHDLKKAWKVSVLTAVIKHMSPDISKIRKLVRQSKCLQDKMTAKESATWLAIINQEEALSRKLYPNSFPPVCSDSGFGSYVISDASDYDVEGADDEPKFEAEECKPFDPSAFGIGPRVSTGELLIHPLVSQIKGEVNETKTNSRLVSKRNQPSDEPKAKMDQKIYTCE

SEQ ID NO: 854 - protein, 150 aa, Eucalyptus grandis
STSSQRADKSLIMEHEFSSAKIKALLEILQSQCRGESANAELHGPMGCDDESLFENTGTGDSTYRVKAVKHTTVYSSSPPEGPIKAIVFSQWTSMLNLVEQNLIHFGINYRRLDGTMTLSARDKAVKDFNTDPEIVVMLMSLKAGNLGLN

SEQ ID NO: 855 - protein, 92 aa, Eucalyptus grandis
SEFGGELMNPRSNWLIVYNDDEGDMMLVGDDPWQEFCGIVRKIFIYTREEVQKMKPGTISAKDEDNLMVDEGVFSKKMTSDTLPSASDPKNC

SEQ ID NO: 856 - protein, 74 aa, Eucalyptus grandis
IEALKKRLDDVNAKYAVSVEFTKAMALNHLKNGLPRVFKALMEFSGACTKVFEALNNPREQVGSRENEPRVLPA

SEQ ID NO: 857 - protein, 125 aa, Eucalyptus grandis
QILPPNAKISKEAKETMQECVSEFISFVTGEASDKCHKEKRKTVNGDDIVWALGSLGFDDYAEPLKRYLNRYREVEGERASQNKVTGGESRNEKNLYGDESPEKQLGAASSSPLKFFDVADRSTN

SEQ ID NO: 858 - protein, 113 aa, Eucalyptus grandis
VNSVFELHKLLARPGAIEKVLGVVRQVRPAIVTVVEQEANHNGPVFVDRFNESLHYYSTLFDSLEGCASTQDKAMSEVYLGKQICNVVACEGADRVERHETLAQWRVRLGGAG

SEQ ID NO: 859 - protein, 114 aa, Eucalyptus grandis
SLFNTSKSNKHLWEQISSKMREKGFDRSPTMCTDKWRNLLKEYKKAKYQDRGSAKMSYYKEIEEILRERSKNNQYKSPTASALKVDPYMQFSDKGIEDAGMTFGPVEASGRPTL

SEQ ID NO: 860 - protein, 181 aa, Eucalyptus grandis
DLELKVRELETVMLGPSSDMPHTVDINFLVGSGQMSQETETLMEIISRRDLKEILCACAKAVEDNDTLKFECLISELRPMVSVSGDPIQRLSAYMLEGLIARLASSGSSIYKALKCKEPAGAELLSYMHILYDICPYFKFGYMSANGSIAEVMKDENIIHIIDFQIAQGGQWITLIQALAA

SEQ ID NO: 861 - protein, 58 aa, Eucalyptus grandis
MARSSCNQKLRKGLWSPEEDEKLFNYISRHGLGCWSSVPKLAGLQRCGKSCRLRWINY

SEQ ID NO: 862 - protein, 86 aa, Eucalyptus grandis
MASGMENRGEIPANLKKQLALAVRKIQWSYGIFWSISTRQPGVLEWGDGYYNGDIKTRKTIQAVELNTDQIGMQRSEQLRELYESL

SEQ ID NO: 863 - protein, 182 aa, Eucalyptus grandis
NIQRNEYHNLFNFISGKGLKIMNLGEQGADGVPGVLDVDDDDAVDPHLERIRIEAGVDESDEEDEDFVIDKDDGGSPTDDSGDDESDVSESGDEKEKEKYGKKESRKEVKASSSKKKAKAGDEEGSKKKKQKKKDPNAPKKAMSGYNFFLQTESEKMKRTNPGLSFGDVSREIADKWRGLSA

SEQ ID NO: 864 - protein, 55 aa, Eucalyptus grandis
MSFTGTQVKCKACEKTVYPVEQLSADGVAYHKYCFKCSHCKGTLKLSSYSSMEGV

SEQ ID NO: 865 - protein, 151 aa, Eucalyptus grandis
DKSSSPVPPQDQTGVHVYHPDWAAMHAYYGPRVALPPYYNSAVSSGHGPHPYMWGPPQPMMPPYGPPYAAIYSHGGVYGHPAIPLTPTPLAAETPKKSSANSDNGLVKKLKSFEGLAMSIGSGGDADSADDGTDKRSSQSADSGDSSDEDQ

SEQ ID NO: 866 - protein, 203 aa, Eucalyptus grandis
RFKQLLEEASQDIDHTTDYYTFRKKWGNDPRFEALDRKDRENLLNERVLPLKKAAEERAQAMRAAATSSFKSLLRDRGDITVNSRWSRVKDSLRDDPRYKSVKHEDREALFNEYIAELKAVEDREEKEAKAKREEQEKLKERERELRKRKEREEQEMERVRVKIRRKEAIASFQALLVETIKDPQLPGQSQKLNLTKILRTCE

SEQ ID NO: 867 - protein, 113 aa, Eucalyptus grandis
EIKNYWNTRIKRLQRTGMPIYPTEVCLQVSSENQETHNMGNLHTAGEDNCDLSQADPLEIPEVDFRKLELHLGFSSFWSTLLDVPPCGFGREAMCLSDAYCLPFPSSRSPKRL

SEQ ID NO: 868 - protein, 107 aa, Eucalyptus grandis
TTRIPAANLEDLFDNHNMARIRDVWAPNLEIEMQNIREAIEKYSYVSMDTEFLSGARPIGNFKTSSDYHYQTMRCNVDLLKIIQVGITLADEEGLFPQDCSTWQVQL

SEQ ID NO: 869 - protein, 85 aa, Eucalyptus grandis
MGRSPCCEGNGLKKGPWSSEEDKKLLDFIQQHGHGSWISLPKRAGLNRCGKSCRLRWINYLWPDIKRGSFSPEEEQTILHLHSVL

SEQ ID NO: 870 - protein, 85 aa, Eucalyptus grandis
MPWKTGLTGSKTEEDKALQLCRERKKSVRQAVDGWGSLVYAHFMFVQSLRNVGTALTKFFETESPNGSPSYASMSTTPEPIALTE

SEQ ID NO: 871 - protein, 104 aa, Eucalyptus grandis
GLLRCSKSCRLRWTNYLRPGIKRGSFTDQEEKMIVHLQALLGNRGAAIASYLPQRTDNDIKNYWNTHLKKKLKKLQGQANPDDDDHNHHPQGFNATSHSNPKGQ

SEQ ID NO: 872 - protein, 102 aa, Eucalyptus grandis
MARTPCCEKMGMKKGPWTPEEDQILISHIHQFGHSNWRALPRQAGLLRCGKSCRLRWINYLRPDVKRGNFTDDERDTIIELHQVLGNRWSAIASRLPGRTDN

SEQ ID NO: 873 - protein, 125 aa, Eucalyptus grandis
WTAEEDKKLINFILTHGQCCWRAVPKLAGLLRCGKSCRLRWTNYLRPDLKRGLLSEYEEKMVIDLHAQLGNRWSKIASHLPGRTDNEIKNHWNTHIKKKLKKMGIDPLTHKPLVTNNDNTTDQQP

SEQ ID NO: 874 - protein, 114 aa, Eucalyptus grandis
MDKKPDDDSGKSQDVEVRKGPWTMEEDLILINYIANHGEGSWNSLAKAAGLKRTGKSCRLRWLNYLRPDVRRGNITTEEQLLIMELHAKWGNRDAHKSHNFSLHRFYNIIPIDH

SEQ ID NO: 875 - protein, 127 aa, Eucalyptus grandis
NGDSVKDDLDTDEYETHATVLDKLLAWEKKLYEEVKQGEHMKLEYQKKVALLNKQKKRGASGESLEKTKAAVSHLHTTYIVDMQSMDSTASEINHIRDKQLYPKLAQLVDGMANMWEKMRMHHDKQE

SEQ ID NO: 876 - protein, 153 aa, Eucalyptus grandis
PETVHVQNYSPIHQMGIDGFFPAHPSPQNPSYHSYSPNNRPNFPPPSPQTSQWDYFWNPFSSLDYYGYPTRSSIDHMAMDDETRGLRQVREEEGIPDLEEETEHEECDHHSYVDEDRGNRDANFPTEEVLVEDVDDEEEDEDEGNRHSCESED

SEQ ID NO: 877 - protein, 62 aa, Eucalyptus grandis
VLRAQLMELTDRLRSLNSVLQVVEVVSGLAIDIPEIPDPLMNPWQLPCPMQPITASADMLQL

SEQ ID NO: 878 - protein, 135 aa, Eucalyptus grandis
LTLTAASTVIFAELSWTPGDLIQAEDRAHRIGQVSSVNIYYLLANDTVDDIIWDVVQSKLENLGQVLDGHENTLEVSASQPTRNSPAKQKTFNSPGKQHTFNSPGKQQKFNSPGKQTTLDSFMKRCNSGDPSEHQ

SEQ ID NO: 879 - protein, 138 aa, Eucalyptus grandis
MALEAINSPTAASAPFQFMEEPLSSRFLEPLNKRKRSKRPHHPPSEDEYLALCLIMLARSGAAPKPNHHASPAPLPPPPPPAPTKPEEAAATATATAAPANNLSYKCAVCGKGFPSYQALGGHKASHRKSAAAAAAAA

SEQ ID NO: 880 - protein, 124 aa, Eucalyptus grandis
AIALVLAKREIIRSIGTGLDWSSPSAGSSTSLPEIKGTLVICPVVAVTQWVGEINCSTAQGSTKVLVYHGANRGKTADQFKNFDFVVTTYSLVEGEYRKFVMPPKKKCIYCGKLLYKEKMTVHL

SEQ ID NO: 881 - protein, 196 aa, Eucalyptus grandis
PDLPGDDLALEFEEFDFQSLFDELSPDAAGLLDASDVDASSPGSLSSWIGEIEGMLMKDDEEAVAVEPSQEVFDRFFAGLLVDSPEGGPAEATDGASDKESNSSDGGGGGGGERDEKLVVGDNELSEDADDDDPVSKKQRRQLRNKDAAARSRERKRSYVKELEMKSKYMEGECRRLGRLLQCFVAENQALRLNLE

SEQ ID NO: 882 - protein, 102 aa, Eucalyptus grandis
VISSQSMHLGVLATASHAVTTQTLFVVYYKPRTSQFIISLNKYLEALNNKFTVGMRFKMRFEGEDSPERRFSGTIVGVEDFSPQWDNSSWRSLKVHWDEHAS

SEQ ID NO: 883 - protein, 69 aa, Eucalyptus grandis
FNQLDPRINRKPFSEEEEERLLTAHKLCGNKWAMIARLFPGRTDNAVKNHWHVIVARKQREQSNNARGR

SEQ ID NO: 884 - protein, 74 aa, Eucalyptus grandis
QKYFIRQSNVSKRKRRSSLFDIVAEESVDVPMGSRDFFAVDEQQQETEVNDALQQLPPDVDEECESMDSTNSNT

SEQ ID NO: 885 - protein, 61 aa, Eucalyptus grandis
SSSSRHESRHPIPLLTNGQPMSGEIPCASIDSPSVRTTSGPLGPFDKHVHSLPYVDPRQPV

SEQ ID NO: 886 - protein, 142 aa, Eucalyptus grandis
SPPLSAHVASHKGLHQASKPKIHECNICGSEFASGQALGGHMRRHRSAPPPTATSADATSPTNPPAAAAITTEKSRNILSLDLNLPAPNGGGSPPPSAPPPGELEVPIRHKSTAHHTSLARLGGLPLLKKKEKTGSHVNQCN

SEQ ID NO: 887 - protein, 139 aa, Eucalyptus grandis
AVSDINLVSNSTHSSYEDGGSPRRITSESDPKDAPMGTESLLSAPEAVELSDTGTSFTFKMDSSMQRKPPVDESPRMHPLPMNLTTEEGDNNVSCQLNLSLASSLLQVDHSQQFNRLNVLGSETSKSPDARSNASITES

SEQ ID NO: 888 - protein, 36 aa, Eucalyptus grandis
HPEYNSSPVGYMETNKARLVLEKDDLGLNLMPPSTC

SEQ ID NO: 889 - protein, 176 aa, Eucalyptus grandis
NIGAKADVFHILSGMWKTPAERCFMWLGGFRSSELLKILGNHLEPLTDQQLMGICNLQQSSQQAEDALSQGMEALQQSLVDTLSSTTLSPTGSGNVAEYMGQMAIAMGKLATLENFVHQADLLRQQTLQQMHRILTTRQAARALLVINDYISRLRALSSLWLARPRTENICSAKLF

SEQ ID NO: 890 - protein, 33 aa, Eucalyptus grandis
KKRLMVASAFGEDEKAGRQTRLTVEDLNYLFMA

SEQ ID NO: 891 - protein, 51 aa, Eucalyptus grandis
MRDLCLDQREMASGSSRVEARADAEMALYNELWQACAGPLVAVPRQGERVF

SEQ ID NO: 892 - protein, 77 aa, Eucalyptus grandis
MLSPSGSSPLAQSTGRHPLYRGVRSRSGKWVSEIREPRKTTRIWLGTYPNPEMAAAAFDVAALALKGSDAALNFPHD

SEQ ID NO: 893 - protein, 95 aa, Eucalyptus grandis
FPQGHMEQLEASTNQELNQRIPLFNLTSKILCQVVNVQLLAEQETDEVYAQITLIPAGNLMEPTSPDPVSAETPRTRVHSFCKVLTASDTSTHGG

SEQ ID NO: 894 - protein, 79 aa, Eucalyptus grandis
MGSNINFKNFSTDPTPTNNRPPGNTLLTRQPSVYTLTFEEFQNSIGKDFGSMNMDELIKNIWSAEENQSMASASGACGG

SEQ ID NO: 895 - protein, 57 aa, Eucalyptus grandis
MQACGSYEYSEQYHDEVKPAYGPQISAHSQYLGYNSLRLGLPLRVAEEPVYVNAKQY

SEQ ID NO: 896 - protein, 167 aa, Eucalyptus grandis
PDVPLPSPAGDVTDAEWFYVMSLTRSFSAGDGIPGKALSTGSLVWLTGARELESYKCDRAKEAELHGIRTMVCIPTGDGVLELGSCDVIPENWGLVQRAKSLFGSDLLLPKHPPPPPPPFQLHHDHSDISFADIGIIAGVQENDFAPHDDHEKKVKKKQPLVEGAGG

SEQ ID NO: 897 - protein, 125 aa, Eucalyptus grandis
VAGMTRGRRDGILKSEKTRHVVKIGPMHLKGVWIPYERALEFANREKITEYLYPLFVHDIGALLYHPSNPSGATSRAGNAQNTLAAIDRRRNEARMAASIQGQAVSGVLVSPVAQTAGGRPSVDR

SEQ ID NO: 898 - protein, 120 aa, Eucalyptus grandis
NNLSLYDNGVGSTPRPRSNAEQLIFRAALQDLSQPKSEETPPDGALAVPLLRHQKIALSWMVKKETAINCCGGILADDQGLGKTVSTIALILKERPPTFKQCQENPKQELQTFDLDEDEN

SEQ ID NO: 899 - protein, 58 aa, Eucalyptus grandis
MSLSAKSESIQIRDVWDDNLDEEFARIREIVDDYPYVAMDTEFPGIVVRPVGNFKNSS

SEQ ID NO: 900 - protein, 94 aa, Eucalyptus grandis
MADSDNDSGGHNNANSESAAALAREQDRFLPIANVSRIMKKALPANAKISKEAKETVQECVSEFISFITGEASDGSSSIGGGGGGVVNSGGGSA

SEQ ID NO: 901 - protein, 169 aa, Eucalyptus grandis
KINPDRWEFVNQGFQKGNKHLLKNIKRRCKFSEHRKTSSSTVTSDYQKAENEVELNTLKKGQEVLKTRSLKLREERKSFQHEIEQVAERVRHAECRNQQIFLFLTKAAKSPNFVHHLIQKKSQKRDLETCESSKKSKLLGSDAEATKFLNEAMDHMIKSPNVDCLRISD

SEQ ID NO: 902 - protein, 266 aa, Eucalyptus grandis
GILAAAAHAAANNSPFTIFYNPRASPSEFVIPLAKYNKAFYTQVSLGMRFRMMFETEESGVRRYMGTITGISDLDSVRWKNSQWRNLQVGWDESTAGERPSRVSMWEIEPVVTPFYICPPPFFRPKFPRQPDDESDVENAFKRAMPWLGDEFGIKDTPNSIFPGLSLMQWMSMQQSNPLQATQSGLLPPMLSSTGLHNNLGIDDPSKLLSFQAPTQGLQFNKTNPQNQVSQLLQPSMAWSQQHQLQQLLQNPLGHQQQQQQQQLQR

SEQ ID NO: 903 - protein, 101 aa, Eucalyptus grandis
VPSMKPEYPVPNGIGASDFGESFRFQKVLQGQENLGFGTPYDGIETQSHRLSEVRRHHPDDSGGSEAAATRNGITNPSVNASVTYKGMGFGESFRFREVLQ

SEQ ID NO: 904 - protein, 142 aa, Eucalyptus grandis
PPSPLLPPPSIPKTLLRIDSGSPLRPPPPPAAMDAAPPGGGGGGGGPAPFLLKTYEMVDDAGTDEIVAWSSGKTSFVVWNPPEFARLLLPTYFKHNNFSSFIRQLNTYGFRKIDPERWEFANEEFVKDKKHLLKNIHRRKPI

SEQ ID NO: 905 - protein, 80 aa, Eucalyptus grandis
MYVLEGVTPCIQSMQLQAGDTVTFSRMDPEAKLIMGFRKASTSMMQDSQLAAVSNGNHSSEALISGGFENVPMISGYSSL

SEQ ID NO: 906 - protein, 30 aa, Eucalyptus grandis
RTGKAESECLCPRNSGLLDALVHESKTMSS

SEQ ID NO: 907 - protein, 69 aa, Eucalyptus grandis
MNQVADRQIPFYNLPSKILCRVINVQLRAEPETDELFAQVTLLPVPNQDETAVEKETGIPCLQRPRVHS

SEQ ID NO: 908 - protein, 60 aa, Eucalyptus grandis
TFMGICSLQHSSQQAEEALSQGLEQLQQSLVDTIAGGPSIEGMQQMAIALGKLTNLEGFV

SEQ ID NO: 909 - protein, 139 aa, Eucalyptus grandis
IGYPKMPLQASISTQSDFQADGSGHGVPIPQGADSGSLGISALPTIQRDSGVHVKQTTSESSREDSDDEEFEGDTGTTENKDPAEVRRARRMQSNRESARRSRRRKQEHMSELENQVEHTGLLKRLTDMNQKYDVASVD

SEQ ID NO: 910 - protein, 153 aa, Eucalyptus grandis
GTGGNWIALPRKAGLKRCGKSCRLRWLNYLRPDIKHGGFTEEEDHVICTLFFTIGSRWSVIASKLPGRTDNDVKNYWNTKLKKKLMKQLASLKTVPESNFDYQVCAQNSASIDPETKNREYAANSMGFPKQNFNPGIPTSNSSLLCPPSLTEV

SEQ ID NO: 911 - protein, 118 aa, Eucalyptus grandis
TSCADNCRLSLSLIQAPVFSSILSKKLLCFFSLSLSTMARPQQRYRGVRQRHWGSWVSEIRHPLLKTRIWLGTFETAEDAARAYDEAARLMCGPRARTNFPYNPNMSQSLRRSSSRRH

SEQ ID NO: 912 - protein, 88 aa, Eucalyptus grandis
MEAAAAAAKVVGEAEELPKTIVRRVVKEKLSRCSDDGDVSLHKDALLAFSESARIFIHYLSATANDICKESKRQTINADDVLKALEEM

SEQ ID NO: 913 - protein, 84 aa, Eucalyptus grandis
PVHEQGQLRGVDRLEGSHWVPIGWERISALAQTVQVDAGWGMQLDSMDDDEDLTVADMETPYWERPAGPIWWCHFSAGHPAVEA

SEQ ID NO: 914 - protein, 184 aa, Eucalyptus grandis
MKPTIDLEVEAVSENDSEISSQVASNLSNQEPSMGPSNDSLANSSYLISPSAVGSGSETVFLDLSLGCSNDESSGRDSVGVAFSSTSECSNEPESHPAAAGPTTSRVFSCNYCQRKFFSSQALGGHQNAHKRERTLAKRAMRMGMFSSQRYSSLASLPLHGSPTVRDLGIKAHSSVHQVHQGML

SEQ ID NO: 915 - protein, 96 aa, Eucalyptus grandis
MWNPSAAQEDDDSWEVRAFAEDTSNIMGATWPPRSYTCSFCRREFRSAQALGGHMNVHRRDRAKLHQSQFRPLANQNSPFASCSSPSSSTLLFPNQ

SEQ ID NO: 916 - protein, 176 aa, Eucalyptus grandis
MAELDYCQTKSSPGAAATRLKLFGFNVSDEEDSAVSDPITVGANGGGGGGGGKATPSGSPEGSVPVGGGGERKYECQYCCREFANSQALGGHQNAHKKERQQLKRAQLHASRNAAVSSLVRNPIISAFATPPHLLATVGPVVVTGAAPTSPSWVYVPRGAPPFQVSHGCVFTTGQG

SEQ ID NO: 917 - protein, 138 aa, Eucalyptus grandis
EHQSNPWHQSSSAANHRQLNLELALEPCSPSSSSSPASLHPLAVPAKDNKLYSCNFCQKKFYSSQALGGHQNAHKLERTLAKKSRDLCSAAKPPAATSNGHHVRPSFQSVVYENQPRLARHVGDDMRYAGTNPLYGSS

SEQ ID NO: 918 - protein, 68 aa, Eucalyptus grandis
QLSSVDREARVLRYREKRKNRKFEKTIRYASRKAYAETRPRIKGRFAKRADIEAEAERMFGFGVVPSF

SEQ ID NO: 919 - protein, 224 aa, Eucalyptus grandis
RGPWTVEEDLTLVNYIANHGEGRWNSLARSAGLKRTGKSCRLRWLNYLRPDVRRGNITLEEQLLILELHSRWGNRWSKIAQHLPGRTDNEIKNYWRTRVQKHAKQLKCDVNSKQFKDAMKYLWMPRLVERIQAASASVSTATVAAAAMAAPPTMATTAASNIGGMAFPPALAGMGGDFRGGRVNVAPSYSTPENSCTTASSDSFGAQVSPVSDLTDLDRVLTLS

SEQ ID NO: 920 - protein, 286 aa, Eucalyptus grandis
MSLWADYDHAAATDLSAFWPPPATPPPPAPAPPLSQESLQRRLQALIEGARGRDGEEGAGGPAAAWTYTIFWQSSGDYSGPVLGWGDGYYKGDGRARSRGSACSQAEQEHRKKVLRELNSLISGAPPADDAVEEEVTDTEWFFLVSMTQSFAGGVGLPGRAYFSSNPAWVTGAERLGNCGCDRARQAQIFGLQTIACVPVLNGVVELGSTEPIYQSSDLISGIRGLFNFHESEMGCGGRVLNSEHDPASLWICDPPVTMEINDRPMTFQIENPSSSSLTESPSAIC

SEQ ID NO: 921 - protein, 101 aa, Eucalyptus grandis
MVPPFPTAELPLNENDSQDMVIYHVLNEAMSQNNSSLPHPNQSGSPSSGGSLEPSRGITKKHYRGVRRRPWGKFAVRFATRYATGPEFGSGHSRQPRRRRW

SEQ ID NO: 922 - protein, 139 aa, Eucalyptus grandis; identical to SEQ ID NO: 909

SEQ ID NO: 923 - protein, 222 aa, Pinus radiata
MGQQSLIYSFVARGTVVLAEYTEFKGNFTGIAAQCLQKLPASNNKFTYNCDNHTFNYLVEDGFAYCVVADESVGRQVPMAFLERVKEDFKRRYGGGRADTAVANSLNRDFGSKLKEHMQYCIDHPEEISKLAKVKAQVSEVKGVMMDNIEKVLDRGEKIELLVDKTENLRFQAQDFQKKGTELRRKMWFQNMKVKLIVLGIVVALILIIVLSVCHGFNCSKK

SEQ ID NO: 924 - protein, 105 aa, Pinus radiata
MGRGKIEIKMIENTANRQVTFSKRKGGLLKKAHELSVLCNAEIALIVFSNTGKLHDWSSSSMKKVMEKYQKSDQGLGLMDYQQQQLLCEMKRITKENESLRARLR

SEQ ID NO: 925 - protein, 102 aa, Pinus radiata
VPSPLVPTRENYFVRYCKQHSDGIWAVVDVSLDTLRGNPQPHPNCPPSTLRCRRRPSGCLIQEMPNGYSKVTWVEHVEVDERAVHRIYDKLVSTVSRRTPYR

SEQ ID NO: 926 - protein, 176 aa, Pinus radiata
LSNIEPKQIKVWFQNRRCREKQRKEASRLQTVNRKLTAMNKLLMEENDRLQKQVSQLVYENGYMRQQLQNASVAATDTSCESVVTSGQHQHNPTPQHPPRDASPAGLLSIAEETLTEFLSKAKGAAVDWVQMPGMKPGPDSIGIVAISNTCNGVAARACGLVGLDPTKVAEILKDR

SEQ ID NO: 927 - protein, 68 aa, Pinus radiata
ILPEGPPESRSVIDNRQVEGSILTIAFQILVNDLPSAKLTLESVETVNNLISCTAQRIKAALHKVEDV

SEQ ID NO: 928 - protein, 68 aa, Pinus radiata
MGRALGRTEIKRIENEVSRNVSFRKRRRGLLKKAAELSILCDATVGVVVFSPAGKLSEYASTSESNGY

SEQ ID NO: 929 - protein, 126 aa, Pinus radiata
IRNPTNRHSSFYKRKGGLLKKAFELAVLCDAEVALIIFSETGRIYEFASHDDVTTVLAKYRIQTKTAGNAMPSSLQKTEFDQLQVRMLQEKIDNLEKTKKHMVGENLESLTWKELQQVEKKLSKAT

SEQ ID NO: 930 - protein, 90 aa, Pinus radiata
LFHPARIGGFGGGQVILPLAHTVEHEEFLEVIKLENHGLTQEEALLSRDMFLLQLCSGLDENAVGACAELVFAPIDASLADSSPLLPSGF

SEQ ID NO: 931 - protein, 138 aa, Pinus radiata
MGRGRVQLRRIENKINRQVTFSKRRNGLLKKAYELSVLCDAEVALIIFSTRGKLYEFASSSMNKTLERYEKCSYAMQDTTGVSDREAQNWHQEVTKLKGKVELLQRSQRHLLGEDLGPLNVKELQQLERQLEVALTHL

SEQ ID NO: 932 - protein, 161 aa, Pinus radiata
MGQQSLIYSFVARGTVVLAEYTQFTGNFTTIANQCLQKIPASNNKFTYNCDRHTFNYLVEDGYTYCVVADESVGRQLPIAFLERIKDDFKKRYGGGKADTAVAHSLNKDFGPKLKDHMQYCVDHPEEINKLAKVKAQVSEVKGVMMENIEKVLDRGEKIEL

SEQ ID NO: 933 - protein, 54 aa, Pinus radiata
FPTGNGGTIELLYMHTYAATTLASARDFWTLRYTTVLEYGSLVVCERSLSGTQG

SEQ ID NO: 934 - protein, 123 aa, Pinus radiata
RREACCPQPSLMARAPHHHQQQQHHQHHQQEASRMVTSLEVDIDTACSSKPNDSIDALKSKIACHPHYPQLLAAYMDCQKVGAPPEVVTVLDEIIQENQLGRHSGTMDIGVDPELDQFMEAYC

SEQ ID NO: 935 - protein, 113 aa, Pinus radiata
MGRGKIEIKKIDDVTSRQVTFSKRKMGIFKKAHELSVLCDAEVAVLIFSNTGRLYDYASSRCMERTIERYEKCTKAINCPTSDPIVENKSPIQEGIEILRQKLRALQRLQRNL

SEQ ID NO: 936 - protein, 162 aa, Pinus radiata
VQEVAHIANGSHPGNCISLLRVNACSTSQNVELILQESCTDASGSVIVYAPVDVPAINIAMSGEDPSYIALLPSGFAILPDGQNRSSTSSLLEGANSSSNSSNSSGLDSPLTRGGSLLTVAFQVLVSHLPTAKLGLDSVTTINNLICNTVQQIKSALHCADV

SEQ ID NO: 937 - protein, 114 aa, Pinus radiata
NRRARTKWKRNEVECDNLKRCCESLREENRRLEKEVQSLRAMKVPQSPNSMPLAAATLAMCPACEGLAIKNRGAATSSTAKSQQSLLTIMGIGDVNMISKNNQTPSMGMGDEMN

SEQ ID NO: 938 - protein, 120 aa, Pinus radiata
MLKTLERYQKCSYVLQDATVSDREAQNWHQEVGKLKAKVELLQRSQRHLLGEDLGPLSIKELQQLERQLEVALTHVRSRKTQVMLEMMDELRRKERILQEVNKSLRKKLQEAEGQAFNAM

SEQ ID NO: 939 - protein, 110 aa, Pinus radiata
SDTANSSELLGSSRSDGDHPHHGHHDQQQQQQENHMVWQNSRLKADVLQHPLYDQLLAAHVACLRIATPVDQLPKIDAQLAQQHHVVAKYSVLGRNQLLTGEEKEELDRF

SEQ ID NO: 940 - protein, 86 aa, Pinus radiata
RNYLGEYTGELISHREADKRGKIYDREDSSFLFNLNDQYVLDAYRKGDKLKFANHSPTPNCYAKVIMVAGDHRVGIFAKERIAAGE

SEQ ID NO: 941 - protein, 128 aa, Pinus radiata
MGRGKIEIKMIENATNRQVTFSKRRGGLKKKAQELSVLCNAEVALIIFSSTGKLHEWSSSSSFFMLQKSMKKILERYQKSEQGLGLMDYQHQQLLCEMRRITKENESLQERLRHMNGEEVNSLKLPEL

SEQ ID NO: 942 - protein, 86 aa, Pinus radiata
AICSISFHPYPKDADKHLLARQTGLTRSQVSNWFINARVRLWKPMVEEMYMEELREAETQNHAADSKVTTESGQNNEETVSKEGAG

SEQ ID NO: 943 - protein, 58 aa, Pinus radiata
GAGYSSVSGIDEHAAGFCSQLVFAPIDASFADDAPLAALWFPSNSSRIWIRMFLLQNG

SEQ ID NO: 944 - protein, 112 aa, Pinus radiata
DGGGRGAGHFVMEQFIPEQAVISDSSISSVKTEVCSGSGGQFELIRRKEEGRCGRAYAEPSFVVTPLVTSLPPQQQEGRMVTSLAVDMDSSCSCKPNEADAMRAKLFAHVHY

SEQ ID NO: 945 - protein, 134 aa, Pinus radiata
ARGKTQMRKIESATSRQVTFSKRRNGLMKKAYELSVLCDAQLGLIVFSPRGKVYEFSSTCMQKMLARYEKCSEGSDTSTSKEQDVQCLKRESANMEERIEILESMQRKMLGEELASCALKDLNQLESQVERGLR

SEQ ID NO: 946 - protein, 110 aa, Pinus radiata
SLVWGALKMGKTKMEIKRIQNPSRRQVTFSKRKNGLLKKAFELSVLCDAEVALIIFSETGKICEFASHDDMATILEKYRIYTETHGNMESSSVQSVKIGESQLKALREKM

SEQ ID NO: 947 - protein, 92 aa, Pinus radiata
KLPKEARQKLLDWWTRNYKWPYPSESQKIALAESTGLDQKQINNWFINQRKRHWKPSEEMQFVVMDSPNPHNAAFFLEGHLRTDGTAFSMDC

SEQ ID NO: 948 - protein, 155 aa, Pinus radiata
FSCVSKAAMILAEHSEGDAELEEVAGECLERVPPLHSRFTHTTKRKMYSFLMDGPFVYCAIVDEALGKPQVFVFLEHVRDEFKKLLKNRGCEGLSSCCFDKEFGPVYKRLVAPLVGVPQIEKDRLMEEESKSQPAKTHPVQVNNSPKDSLPVYDN

SEQ ID NO: 949 - protein, 165 aa, Pinus radiata
DGSLVICERSLSAAQGMPMVSQSQSFVHGELLSSGYLIRPCEGRGALVIMVDHRNLEASSVPEALRPLYESSTFFAQKMTVEASYHLQGKVQPEMISLSKKLQQPCNVRSYSQRLCRGFNEAVNTLPDDGWMSLSKDGLGDVTICESFVKLPEPNASQIAYVNSM

SEQ ID NO: 950 - protein, 153 aa, Pinus radiata
RALQQLGMIQQHAWRPQRGLPERSVSVLRAWLFEHFLHPYPKDADKHMLARQTGLTRNQVSNWFINARVRLWKPMVEEMYVEETKEAEVDHGSNDKTGKESGEKKEDALSKEGAAGNNGNIHEQQSGKISKLDNIAQDGGADEKPAGVPKSEN

SEQ ID NO: 951 - protein, 107 aa, Pinus radiata
MNLMESFEAKGKGEKRRTVRGKTQLKRIENGTSRQVTFCKRRNGLLKKAYELSVLCDAEVALIVFSPRGKLYEFANPSMQKMLERYEKCSEGSNPTSTAKEQDVQCL

SEQ ID NO: 952 - protein, 217 aa, Pinus radiata
MVRGKTQMKRIENDTSRQVTFSKRRNGLLKKAYELSVLCDAEVGLIIFSPRGKLYEFASPSMEEILEKYKKRSKENGMAQTTKEQDTQYSKHSKQKLANMEEQIRILESTQRKMLGEGLESCSMAELNKLESQAERGLSHIRARKTEILVDQIECLKRKERLLSEENALLSRKWVDRQSVDGSGSTSSSIGLGSIEQIEVETQLVIRPPNAQDHCSV

SEQ ID NO: 953 - protein, 183 aa, Pinus radiata
MESEEDKISPENKKRRLKTPQQVEGLESFYAEHKYPSEAMKSQLSEELGLTEKQVQGWFCHRRLKDKRLMKEEASNNGKQDPHNGIMQDSVNGVKQDSSGSGKKSDHQRHSRCKEVESQRFANAMDYPAAVLASELRDHDLFKVNHDNEDTFAGSSSASQDRSSLQSGNPYEAEARRRPFQNG

SEQ ID NO: 954 - protein, 105 aa, Pinus radiata
ALFGAVQSLPVFTFANQAGLDMLETTLVALQDISLEKILDDNGRKSFCSDIAQIMQQGYAYLPAGVCVSSMGRPASYDRAIAWKVLNDEENPHCIAFMFMNWSFV

SEQ ID NO: 955 - protein, 85 aa, Pinus radiata
QRIWHEPASNNKFTYNCDNHTFNYLVEDGFAYCVVADESVGRQVPMAFLERVKEDFKRRYGGGRADTAVANSLNRDFGSKLKEHM

SEQ ID NO: 956 - protein, 119 aa, Pinus radiata
VNSNQSNMLILQESCTDASGSFVIYAPVDIVAMNVVLSGGDPDYVALLPSGFAILPDGPKCMAVTNSGINDLGSGGSLLTVAFQILVDSVPTAKLSLGSVATVNSLISCTVDRIKAAVT

SEQ ID NO: 957 - protein, 90 aa, Pinus radiata
QLLFHLRSQSISPLVTCLRSHRAPPWPTPISWLCIIIRVMTEEQMETLRRQICVYSTIGSQLVEMHRAMSQQQAFFSGRLCLWDNTCFMI

SEQ ID NO: 958 - protein, 103 aa, Pinus radiata
MGRGRVELKRIENKINRQVTFSKRRNGLLKKAYELSVLCDAEVALIIFSSRGKLYEFGSAGYGIEISGLFSGILYYNIRVGEGCEGEKRGCKVYSVICFKGKS

SEQ ID NO: 959 - protein, 63 aa, Pinus radiata
MVRGKIQMKRIENTASRQVTFSKRRNGLLKKAYELSVLCDAEVGLMIFSPGGKLYEFANTSME

SEQ ID NO: 960 - protein, 60 aa, Pinus radiata
MLLQNVPPALLVRFLREHRSEWADCNIDAYSSATMKANAYNVPGSLGGITGSQVILPLAH

SEQ ID NO: 961 - protein, 52 aa, Pinus radiata
TSRLHFVDQQLRQQRALQQLGMIQQHAWRPQRGLPERAVSILRAWLFEHFLH

SEQ ID NO: 962 - protein, 154 aa, Pinus radiata
AVVIWMGDPERTKMPPIKITITITIMITSSSRRGGNVTTDTLLVKFRRWKRCLRSVHILMTNKGSGSALNWALKPRQVKFWFQNRRTQMKAQQDRSDNAILRAENENLRNENVALREAIKNGACPNCGGSTSLGEMPGFDEHHFRIENTRLKEE

SEQ ID NO: 963 - protein, 143 aa, Pinus radiata
RILKLEIPTSYLVCKARKMGKKKVEVKLIQNPTSRQGCFYNRKCGLLKKAFELSVLCDAEVALIIFSQTGKIYEFASHDDVNAILAKYRIQTGTTTNAMPSSLQNTEPETLHEETNMLGKRKKVEKLHEKINMLEKRGKNMVW

SEQ ID NO: 964 - protein, 123 aa, Pinus radiata
DHHAVEDRELKNHLLRKYSGYLSSLKQEFMKKKKKGKLPKDARQKLLDWWSLHDKWPYPSETEKIALAECTGLDQKQINNWFINQRKRHWKPSEDMHFMVMNSHSPHSAALYVERHMMTEGYL

SEQ ID NO: 965 - protein, 71 aa, Pinus radiata
MEHLNAAAAQASSSLYGVSMAEYGDVGVSSMMALMTQHEPHESESTMTTSMPSSFSSFHGHAECLLSAAMF

SEQ ID NO: 966 - protein, 111 aa, Pinus radiata
MGRGKIEIKKIENSVHRQVTFCKRRGGLMKKAYELSVLCDADVALIVFSSRGKLYELGTSNNNNNSMRSILERYQKCSQTAKHMNFSNNTSDEKMKQEINLLKHKLISTYQ

SEQ ID NO: 967 - protein, 106 aa, Pinus radiata
MNYEQRLIAAARLADNLNSTTAKEFDIPSAEEVAEKCSEWGVTAQLKAHQAQGLSWLIRRYAIGVNVILGDEMGLGKTLQAISLLAYLKDRRKCPGPFLVLCPLSV

SEQ ID NO: 968 - protein, 257 aa, Pinus radiata
SVDVLTAFSTGNGGTIELLYMQMYAPTTLASARDFWTLRYTSVLEDGSLVVCERSLSGTQGGPSMPAVQQFVRAEMQPSGYLIRPCEGGGSLIHIVDHMDLEPWSVPEVLRPLYESSTVLAQKVTMSALRHLRQIAQEASSDVVLGWGRQPAALRTFSQRLCKGFNEAVNGFTDDGWSLMGNDGMEDVTILVNSSPSKLFGQQFASSDGLPALGGGILCAKASMLLQNVPPALLVRFLREHRSEWADSNIDAYSAAS

SEQ ID NO: 969 - protein, 135 aa, Pinus radiata
MAMEERSGDLLKGCGLSENALDAISEGSIQNHWSWSEVKQLSVTLLRALDAGIEHSLLGSMMSIDRYAAAESFHRLAWAYAHVPDLHIMWLLHLCDAHQEMQSWAEAAQCAVAVAGVIMQALVGRNDAVWGKEHV

SEQ ID NO: 970 - protein, 128 aa, Pinus radiata
RGRVQLRRIENKISRQVTFSKRRNGLMKKAAELSILCDAEVALIVFSNKDKLYEFASSSMTKILERYRKRSNLIQDIGKDPQNSDIELTRLKEEVDRLQRSRRHLLGEDLHQLGATDLQHLEQQLEEA

SEQ ID NO: 971 - protein, 147 aa, Pinus radiata
MDSFEAKGKGEKRRTVRGKTQMKRIENATSRQVTFSKRRNGLLKKAYELSVLCDAEVALMVFSPRGKLYEFANPSMQKMLERYEKCSEGSKTTSIAKEEDPKALKREIANMEERIEILERTQRKMLGEELASCALKDLNQLESQVER

SEQ ID NO: 972 - protein, 45 aa, Pinus radiata
MEKQNSGEDSDSKGQLDNGKYVRYTNEQVETLERAYNECSKPSTS

SEQ ID NO: 973 - protein, 97 aa, Pinus radiata
MGAFALLSSWIDAATNPKYRKKRKQFQTVELRVRMDCEGCERKVRNALNSMKGVSSVEVERKQYKATVTGYVDANKVLKRVRQTGKKAELWPYKPYH

SEQ ID NO: 974 - protein, 135 aa, Pinus radiata
FSNTWFSGNLLAPGANKQMHLDSSSTGAPGLSNVLIGSKYLKAAQQLLDEVVNVGKGIKPDSAKHQKSQSWIGTTANKENSGAEGGGKDGAAAAPTWRSTSAQETNDRPSELSPAERQELQMKKAKLVAMLDEVD

SEQ ID NO: 975 - protein, 93 aa, Pinus radiata
YSEVRTRARFWRRKGRVRRFKYTCKSAGHPSIRKRIKDGKGQPCRQYTPCGCQLTCGKQCPCLRNGTCCEKYCGCSKSCKNRFRGCHCAKSQC

SEQ ID NO: 976 - protein, 114 aa, Pinus radiata
ADESLWIPNLDAGKETLSYEEYMRQFPSTITPKPIGLATEATRETGMVITNSLNLVETLMDVDHWKEMFPCMISRAATVDVISSGMGGTRNGALQLMYAELQVLSPLVPAREYF

SEQ ID NO: 977 - protein, 148 aa, Pinus radiata
QSENIMSTRIPSSFSSFHGHADCLLSAAMFQGSQGDHKLNPQPGMNQQLVSEQSIMSDSSMPFVKTKACSGLRNQFEFHREQPGNCYTDQSSNIPLSPIVTSLASQARGEARMIPSLDANSAHFNVDNEEHAIKSKILAHPQYPSLLG

SEQ ID NO: 978 - protein, 107 aa, Pinus radiata
MRNPICTNCGGPAVLGEMSFEEQQLRIENARLKEELDRLCALAGKFFGRPIPSMPSVPLMPKSSLDLGVGGMPTSLPSASADLMHGPAGGRTGNIIGIERSMLAELA

SEQ ID NO: 979 - protein, 251 aa, Pinus radiata
MMMSGGRMYGGPNVLVTANENISRSADALEALLSSPVFNGSRSVANLEEVIGNVSKRSFYNSFDQEETGDEDLDDCIHPPEKKRRLTADQVQFLERSFEIENKLEPERKIQLAKELGLQPRQVAVWFQNRRARWKTKQLERDYDILKSRYENLRVDYDSLLKEKDKLRAEVTFLTDKLHDSDHEALTKDSESADKKVYPQPASHSDCVGEPERSTAAKDTPPGCKHEDLLSSGTDSSGVLDEDSPHHVDCG

SEQ ID NO: 980 - protein, 128 aa, Pinus radiata
KIENTTSRQVTFCKRKNGLLKKAYELSLLCDAEVALLIFSTSGRLYEFANKSVSATTERYMRTYAENMPQSRALYPDCHHWQEEVRKLTQQRDSLTNSIRQIMGEGLESLSMKELKHIQVQLEKSISC

SEQ ID NO: 981 - protein, 119 aa, Pinus radiata
YTAEQVEALERLYNDCPKPSSLRRQQLIRECPILSHIEPKQIKVWFQNRRCREKQRKEASRLQTVNRKLTAMNKLLMEENDRLQKQVSQLVYENGYFRQQIQTVSITTTDTSCESVVTS

SEQ ID NO: 982 - protein, 85 aa, Pinus radiata
KHEFDVRYQKLEDKLYIAQLYFPLIGLILDEMPVFYNLSTVEKREVLICIMQIIRNLDDPSLIKAWQQSIARTRLFFKLLEECLV

SEQ ID NO: 983 - protein, 96 aa, Pinus radiata
GLLVTMRLFAATEPKRVFAVTKRIFLLGFVSFFLREGLVASVWLPVSPQRLFDFLRDERLRSKWDILSNGGPMQEMAHIPKGQDPRNCVSLLRASI

SEQ ID NO: 984 - protein, 109 aa, Pinus radiata
LVSLYNNHLNGILADEMGLGKTVQVISLICYLMEQKNDRGPFLVVVPSSVLSGWLSEISFWAPSISKIAYTGSPDDRRRLFRENISQQKFNVLLTTYEYLMNKRSTKTE

SEQ ID NO: 985 - protein, 52 aa, Pinus radiata
PKDADKHMLARQAGLTRSQVSNWFINARVRLWKPMVEEIYMEEIKEAELGHS

SEQ ID NO: 986 - protein, 101 aa, Pinus radiata
QQDDDAKVYESPLRRKNAEAPRTRWRFLPLESALENPYQGLMKHCTSLLKTLMNHKFGYVFNEPVDPVALGVPDYFTVITSPMDLGTIKAKLQDSVYSSPL

SEQ ID NO: 987 - protein, 230 aa, Pinus radiata
CTGVAARACGFAGLEPSKVADILKDRPAWLHDCRRLDVLTAFPTGKGGAVELLYTQMYAPTTLAPARDLLTLRYTSLLEDGSLVVCERSLTGTQSGPNMPPVQHFVRAQMLPSGYLIRPCEGGGCIIHIVDHMDLEPWSVPEVIRPLYESSAVLAQKMTITALRHLRQVAQEVSGEVVLGWGRQPAALRAFSQRLCRGFNDAVNGFADDGWSLLGSDGVEDVIIAINSSP

SEQ ID NO: 988 - protein, 164 aa, Pinus radiata
QYLRQQLQLLHARAGNNTRSLQQMAVTANDTSSDSVVTSGQRQQHSPQHPPYSVSTSRLFFIAEETLTEFLAKATGTAVDWIQMPGMKPGPDSIGVVAVAHACGGVAVQAWGVVSLEPSEVAEALRDKVSWLCDCRKMEVLGTFDSTDGRKLELLHTQMYAPIT

SEQ ID NO: 989 - protein, 107 aa, Pinus radiata
MGKTKMEMKHIQNPSRRQVTFSKRKNGLLKKAFELSVLCDAEVALIIFSETGKISEFASHNDMATILEKYRIYTQTETDGNMGASSVQSVKGWFPNFLEIAGFSVCG

SEQ ID NO: 990 - protein, 68 aa, Pinus radiata
MGRGPVQLRRIENKINRQVTFSKRRNGLIKKASELSILCDAEVALIVFSNKGKLYEFSSSSMTKILER

SEQ ID NO: 991 - protein, 230 aa, Pinus radiata
LSLSPQQLSNIQLSCFQNQPTDSEVNCPSISEATSQENLNRSDRLTSKLSGSLSSFRASSRDGMLGTKFLGSVNGPECNKPMHHGTNAIGAAELSNTLTGSKYFKAAQQLLDEVVNVGKGIKSDSVNHQKSQTWFGAISDKKNIATEATTNDRTTSAITGASISAEVMKNEHAFGLTPADRQELQMKKAKLVAMLDEVDRRYRQYYHQMQIVVSSFETAAGFGAAKTYTS

SEQ ID NO: 992 - protein, 76 aa, Pinus radiata
MGRGKIELKKIESTSNRQVTFSKRRMGLLKKAQELSVLCDAEVGVIIFSNTGRLYDFSSSSMEKMIETYYRFIEKN

SEQ ID NO: 993 - protein, 77 aa, Pinus radiata
VTLFLVLQVLDRGEKIELLVDKTENLRFQAQDFQKQGTQLRRKMWFQNMKVKLVVLGIVFVLILIIWLSICHGFKCH

SEQ ID NO: 994 - protein, 110 aa, Pinus radiata
PNSRSDGNGKADRSDSMGTEARTRTRFWRRRGRVRRLKYTWKSAGHPSIKKRIADSKDQPCRQFTPCDCQSMCGKQCPCLRSGTCCEKYCGCSKGCKNRFRGCHCAKSQC

SEQ ID NO: 995 - protein, 293 aa, Pinus radiata
ASQFSGNDMRNYGAKEVTSGLATGGQRPPALQLNLAALDSSGDGAAAKEKRTPKVNPYYLNSEFVMGKDKMPPPPPDNKKGGMKRTAQGKSEIRETKRPVADPMNGKILQDVMKQCGFLLSRLIKHKHGWVFKAPVDTVALGLHDYNTIIKQPMDLGTAKAKLNANEYKSPQEFAGDIRLTFNNAMTYNPNGHEVHIMAEQMLQFFEDRWKPICDRYEEEKRKLSWSVNDGLLPGASQNMKNFPFGETPKKNLKKTEPLLGLSPRPPPNAKSKANQTLRAPAPKKPKAKDLHK

SEQ ID NO: 996 - protein, 144 aa, Pinus radiata
KFDICVTSFEMAIKEKTALKRFSWRYIIIDEAHRIKNENSLLAKTMRIYSTNYRLLITGTPLQNNLHELWSLLNFLLPEIFSSAETFDDWFQISADNDQQEVVQQLHKVLRPFLLRRLKSDVEKGLPPKKETILKVGMSQMQKQ

SEQ ID NO: 997 - protein, 81 aa, Pinus radiata
MGRGKIETKKIENSVRRQVTFWKRRGGLMKKAFELSVLCDAEVALIVFSGRGKLYELETSHSNRNKYAPYSTSTTHQCRWF

SEQ ID NO: 998 - protein, 114 aa, Pinus radiata
YYLIVIDAKVIQAGLFNNTSTAQDRREMLEEIMRRGTNSLGTDVPSEREINRLAARSDEEFWLFEKMDEERRQKEGYRSRLMEEHEVPDWVFSVPTGKNDKGVENMDSNLGFDQ

SEQ ID NO: 999 - protein, 183 aa, Pinus radiata
ADSPHFNEADAIKSKILAHPQYPNLLGAYIDCQKIGAPPEVAARLDALSHEYENQQHRSSLSIGMDPELDQFMEAYCEMLTKYHEELTKPFKEAMSFLKKIEAQLNSLGKGTIRISPSAENDEKTEGGASSEEVEDGSGGETDFQEVDHHAVEDRELKDHLLRKYSGYLSSLKQEFMKKKKKK

SEQ ID NO: 1000 - protein, 122 aa, Pinus radiata
CKNVFTRLQGPVKEGRHTALFMEIPKRNENPTYYRLIENPIDARTIEQRLDRFSYGSVLDFAADVQLMLENAIRFYGHSSEVKANARRLQALFFQRMADSFPDDNFSSFKTRSLVALGQSAN

SEQ ID NO: 1001 - protein, 115 aa, Pinus radiata
LVNSGMAFGAKRWIATLQRQCERLASVLASNIPSRDLGVIPSPEGRKSILKLAERMVTSFCAGVSASTAHTWTTLSGSGAEDVRVMTRKSVDDPGRPPGIILSAATSLWLPVPPK

SEQ ID NO: 1002 - protein, 130 aa, Pinus radiata
LESQFDQSFEYPPVEQLVKQCGKFGLLERLLKHLKAQKHKMLIFSQWTKVLDLLEYYLSERGYEVCRIDGSVKLEDRKNQIRDFNDPDSNFCIFLLSTRAGGLGINLTDADTCFIYDSDWNPQMDMQAMD

SEQ ID NO: 1003 - protein, 276 aa, Pinus radiata
VKLGTTNTWLSRAVSGQHRAQQQQQQHYAERSVEEGRKWCGCAAGSRDCIHSNFLKLQNPASAGSSSAAANALSGRWLMPGPLLNDKIEGREGVELLGGEIPGESIMALSAQFKTAGSAAPERGLLNLHSADAVNSNGEPVDSGGAGGDRDGGEEAEDHAALWQSARIKADIVSHPLYDQLLSAHLECLRIATPKDQHSMIDAQLEQSQHVVTKYSVLGNDNFLVGDKKELDQFMTQYVLLLCSFKEQLQYHVHVHVMEAVRACIDLQHSLLTLTG

SEQ ID NO: 1004 - protein, 123 aa, Pinus radiata
SCAVQSQPAASGTRWNPTPDQIRILEMFYKGGMRTPNAEQIEHITAQLRQYGKIEGKNVFYWFQNHKARERQKQKRNSSMHQVAATAAKKTPTTIMADNPNELHKPNSNGTYSLYNLPFTAMS

SEQ ID NO: 1005 - protein, 90 aa, Pinus radiata
MGKTKMEIKRIQNPSRRQVTFSKRKNGLLKKAFELSVLCDAEVALIIFSETGKICEFASHDDMATILEKYRIYTETDGNMESSSVQSVKV

SEQ ID NO: 1006 - protein, 123 aa, Pinus radiata
MSVFETGNERKRPAGNSYSALELSDDIGDEDGSDDCIHLGEKKRRLTLEQVRALEKNFEMANKLEPEKKMQLAKALGLQPRQIAVWFQNRRARWKTKQLEKDFNILKHDYDSLKQNYDNLMEE

SEQ ID NO: 1007 - protein, 114 aa, Pinus radiata
MGKTKMEMKHIQNPSRRQVTFSKRKNGLLKKAFELSVLCDAEVALIIFSETGKISEFASHNDMATILEKYRIYTQTETDGNMGASSVQSVKVGESQLKALHERMDNLKKKERNM

SEQ ID NO: 1008 - protein, 90 aa, Pinus radiata
MASNGIMFNASNRNLIVMVNEAPSFEANSSLDGVMKNVSKRPFYNTLDADEAGDEDLLDECVHQPGKKRRLSVEQVRFLEKSFELDNKLE

SEQ ID NO: 1009 - protein, 107 aa, Pinus radiata
LERSIRQQRAFHHLGLMEQHPWRPQRGLPERSVSVLRAWLFEHFLHPYPTDADKHILAKQTGLTRSQVSNWFINARVRLWKPMVEEMYMEELKEEKVDQGTHNSEAE

SEQ ID NO: 1010 - protein, 126 aa, Pinus radiata
MNLNDHTYNLSPMANSGNPEEQIDEDAVDDFMNYQPESKKRRLTVEQVRSLERSFEIETKLEPEKKIQLAQELGLQPRQVAIWFQNRRARWKTKQLERDYSVLKASYDALKSDFERLQQENKNIRA

SEQ ID NO: 1011 - protein, 96 aa, Pinus radiata
MFTISTCTTHAQSLIYSFVARGTVVLAEYTEFKGNFTGIAAQCLQKLPASNNKFTYNCDNHTFNYLDEDGFAYCVVADESVGRQVPMAFLERVKED

SEQ ID NO: 1012 - protein, 110 aa, Pinus radiata
GCPGNIHDDDEEEDEEECSGTGQQTRKKRRLSLQQVRSLEKTFEVENKLEPERKLQLAQELGLQPRQVAVWFQNRRARWKTKQLERDYGQLKLNFECLKSNFDAIKQENQ

SEQ ID NO: 1013 - protein, 108 aa, Pinus radiata
MAGEKRKINRIANASARQVTFAKRRRGLFKKAQELSILCEADVALLVFSSTGKLYQYSSSSMKMILDQYILYSRSIQKDGKPNLEESHDIQKIKQQIKDISQNLRKLR

SEQ ID NO: 1014 - protein, 177 aa, Pinus radiata
MGMDMEDCNTGLGLGMSIGLGMNLMREDLQSHRHHVNGPPVQLDLLPLAPVLPSRDLPWGKTSPGTDGERSAGESKATVPRRIDVNKLPASCYYNEDTGTINVSSPNSALSSFHVDSGGAINAESSCYGMSVKREREATEELEAERACSRVSDEEADQEGGTRKKLRLSKEQSALLE

SEQ ID NO: 1015 - protein, 61 aa, Pinus radiata
MGKKLELKRIQNPNSSRDSFSKCKRGLLKKSVKLFVLCDAEVSLIILSETAKIYEFASNKS

SEQ ID NO: 1016 - protein, 51 aa, Pinus radiata
RFQAQDFQKQGTQLRRKMWFQNMKVKLVVLGIVFVLILIIWLSICHGFKCH

SEQ ID NO: 1017 - protein, 68 aa, Pinus radiata
MGQQSLIYSFVARGTVVLAEYTQFTGNFTTIANQCLQKIPASNNKFTYNCDRHTFNYLVEDGSHTVLL

SEQ ID NO: 1018 - protein, 155 aa, Pinus radiata
MDREKLMKMAGAVRTGGKGTMRRKKKTIHKTATADDKRLQSTLKRIGVNNIPAIEEVNIFKDDHVIHFANPKVQASIAANTWVVSGSSQTKKLQDLFPGIINQLGPESFANLRKIADQFRRPEPNPAQGEDDDDDDVPELVEGETFEEAAKKDSS

SEQ ID NO: 1019 - protein, 249 aa, Pinus radiata
MMQPAVGVAPPPPVAAPAMDPQQQQQQWMMMQQQMQPQQAQPQPPPQAGFWPPQHQPQPQHAQSQLMAQQYPQQPTSADEIRTLWVGDLQYWMDETYLHGCFGNSQEVVSVKIIRNKQTGQSEGYGFVEFASHAGAERALQTYNGAQMPNTEQFYRINWATFGIGEKRPEIGPDYPIFVGDLASDVTDYLLQETFRTRYQTVKGAKVVTDRVTGRSKGYGFVRFGDENEQVRAMTEMNGVFCSSRPMRI

SEQ ID NO: 1020 - protein, 82 aa, Pinus radiata
ASFGLGERRLLTGPEHSIFVGDLAPDVTDYLLQETFRSRYTSVRGAKVVTDPSTGRSKGYGFVKFADENERNRAMTEMNGVY

SEQ ID NO: 1021 - protein, 107 aa, Pinus radiata
RQEPSLKKQIIETSEKAIVFSQWTSMLDLLEVPLKKSCIQYRRLDGTMSVIARDKAVNDFKTLPEVTVMIMSLKAASLGLNMVAASHVLLLDLWVESQQLKTKLLTG

SEQ ID NO: 1022 - protein, 99 aa, Pinus radiata
LGFEDYVEPLKIYLNKYRELEGEKSSMAAPPRQSDLQQHHHVNGSDPHPYGHSPHGPMAYHVPGGASFRAWKVTVACSFCYCKEVIEMEMGHGNGDCKV

SEQ ID NO: 1023 - protein, 158 aa, Pinus radiata
MENLPNQQPDLEIAQTHEDPGSRQFKGIRLRKWGRWVSEIRIPKSREKIWLGSYTTPEQAARAYDAAVYCLKGPNAKFNFPETVHDIPSVTSVSRQEIQHAALKYALGQPPPSLQSLEGHAALKYALGQPPPSLQSLEGHAALKYALGQPPPSLQSLQ

SEQ ID NO: 1024 - protein, 197 aa, Pinus radiata
MAFTGTQQKCKACDKTVYFVDQLSADGVSYHKACFRCNHCKGTLKLSNYSSMEGVLYCKPHFDQLFRESGNFNKNFQSQRSSKAIDGLSPEMTRSPSKVSMMFSGTQDKCATCGKTAYPLEKVTVENLSYHKSCFRCSHGGCSISPSNYAALEGILYCKHHFSQLFKEKGSYNHLIKTASMKRAAAVPEVASAVPEI

SEQ ID NO: 1025 - protein, 232 aa, Pinus radiata
KPAGTSRLPEFKSRTITLPSFNIPSSNPRKLLDMVKPSQKQNIHVNGKPESRSLMSRQFKGIRLRKWGKWVSEIRMPNCRAKIWLGSYESPEKAARAYDFAAYCLRGSKARFNFPDSPPEIPCASSLSPSQIQAGAARFAAEEFQMPSDDDTASSSCGSEAESDLPPEIPCASSVSPPPIQAAAPRFAAEEFRLPSDEDTASSSCGSVTESNIDSQQISAEQGSAFWDSLFL

SEQ ID NO: 1026 - protein, 88 aa, Pinus radiata
HQWHRFCSRRLCCTALHNTQKQCTKSAATGKGGIKRIRRQQEAAPSPPEEATLNQQTPPYRGVRRRNWGKWVSEIREPKKKTRIWLGS

SEQ ID NO: 1027 - protein, 501 aa, Pinus radiata
MCGGAIISDFIIPPASRGRRVTARDIWPDFDKFSEFINGGAAVESFDVSVDVDDDEEDSDDDEFLDFEESYQNKKKKQQQPISPTKGFELPLARGLDGPAAKSAVRKRKNLYRGIRQRPWGKWAAEIRDPRKGARVWLGTFNTAEEAARAYDAAARKIRGKKAKVNFVDEPPPSVKKESNNAKGSKKGSSKKIKSYTTPKADFFEGFKTANPSIAQYNFHQKFPNPSCDDLGYQNPLSPLHAICNRNFAAKQSSSALPAYSTEFSDFDDSEVDNLVPQPASFEPMKNINKRKGYNSFESDTSSVSADRSHISWVTEVKTPEISSVPKAEADSDHYDFADMSTPVATSVSAGSPEVQLPPFNNGLNKSPSVEDGVAAEKSPKLEESSQLEISEDLPSLESYPWLFQMPYFEGLDQSLQGVGIGDASFPDGENDLQLWSFDAVPISDSAYISLESLACKQLVIMESRRLVMASFCRPSSNRELVIFPLFFFIQFDGATVISAH

SEQ ID NO: 1028 - protein, 134 aa, Pinus radiata
MAFAGTQQKCKACEKTVYVVDQLTADGSVFHKACFRCHHCNGTLKLSNYSSFEGVLYCKPHFDQLFKRTGSLDKSFEGTPKAVKNEKLNDGEIKTPNRVSALFSGTQEKCLACGNTVYPIEKVSVEGVGYHKAC

SEQ ID NO: 1029 - protein, 76 aa, Pinus radiata
MDGSQNSGGNAVPPFLTKTYDMVDDSSTDSIVSWSPGNNSFIVWNPPEFARDLLPKYFKHNNFSSFVRQLNTYGFR

SEQ ID NO: 1030 - protein, 97 aa, Pinus radiata
HEKKAVLWNMDTLKAKGSLEEHSFLITDVRFSPNSTRLATSSFDRTVKVWDADNPNYTLRTFSGHTGSVMSLDFHPNNEDLICSCDGESEVRYWSVN

SEQ ID NO: 1031 - protein, 117 aa, Pinus radiata
MGYLQELEDQIIGLQNLVKRNERLYGSGNTPSGGVALPFILVQTRPQATVEIEISEDMQLVHFDFNSTPFELHDDAYVLKAMGFCEKPFTDGMDVTGHDSFANGTGFGENNMTITNM

SEQ ID NO: 1032 - protein, 146 aa, Pinus radiata
TRVLLIDDHPLFREGLAGAIQAEPDFEVVGQAGTVDELRGLAPQIEPDVAIVDLLMPSVSGIGVTRELCELLPRCRVLGLSAVVDAAAIAEMLRAGASGFALKTQPAPDILDAVRRTVAGESYLPPSVSREAIDAELAGGAPPSLA

SEQ ID NO: 1033 - protein, 181 aa, Pinus radiata
MSILPKSDSIHIREVWADNLEEEFNLIREIVDDYPLIAMDTEFPGIVVRPVGKFRTVQEYNYETLRSNVDVLKLIQLGLTFSDEDGNLPNCGTDRYCVWQFNFREFNIWEDAYASDSIELLRQSGIDFKKNSERGVDSHLFAELLMSSGIVLNENVRWITFHSGYDFGYLLKLVMNRSLPP

SEQ ID NO: 1034 - protein, 122 aa, Pinus radiata
EHACPMACHPGPCPPCLVSVSKSCWCGSKTLVSRCSVLNKGTSTNAGVGPVLSCGQPCGRLLGCEKHTCEQECHPGPCPPCDIVDVAKCYCGRQERGMACGTGIVETCVVEGEGSWEGRWQC

SEQ ID NO: 1035 - protein, 158 aa, Pinus radiata
MRINEATPKKSLGFQQPYSMKGNYYTQAYGGAVASQAFQSDNDPNNTTIFVGGLDPNATDEDLRQVFGPYGEIVYVKIPVGKGCGFVQFTNRSSAEEALQKLHGTVIGQQSIRLSWGRSPANKQTASWGVQPQADPNQWNGGGAYYGYGQGYEAYGYA

SEQ ID NO: 1036 - protein, 126 aa, Pinus radiata
QYLSPGKSAPFWLCQDMAITSQQHHMNALPYNERSEKRPKFKGIRMRKWGSWGSEIRMPKTRTKIWLGSYETAEQAARAYDAALYCLRGPNAKFNFPDTVPSIPSAFSLSRHQIQLAAARYARDEL

SEQ ID NO: 1037 - protein, 79 aa, Pinus radiata
MEPMDIVGKSKDDVSLPKATMFKIIKEMLPPDVRVARDAQDLLVECCVEFINLISSESNEVCGREEKRTIAPEHVLRAL

SEQ ID NO: 1038 - protein, 132 aa, Pinus radiata
EISLFWLQSFCKLPNMENVPEQEPDNTISLPHEDRGSRQFKGIRLRKWGSWVSEIRMPRSRKKIWLGSYTTPEQAARAYDAAVYCLRGRNAEFNFSVPDIPTASPLSREQIQHAAAEYALGKAPSSFPSFAG

SEQ ID NO: 1039 - protein, 241 aa, Pinus radiata
MNEPDEHAAAQLVQKRSHPLAEVVMPISVRPLAEKCGVEAEEERKRAAEHKKQRSKNWTRAETLKLIRLRAEMEPRFARSGRKSELWEEIAEALRRESVVRDAQRCRDKWEKLTASYKEVRDGQRDRQDFPFFDELDPLLSLKPQKAAAAAAAAATAATAANFVSAETPSNFPTDDEMTEEGSPAGKRRKTTPRGLSATDLDAVRELLESLVSRQQRFFVDLLDSMERKEEIRERIRQEKE

SEQ ID NO: 1040 - protein, 182 aa, Pinus radiata
MVYIVLLDLCESVQPPQGSLQEFSNSIQEEQAMVDLMPKDSRQTMINNTTIFVGRLDPNATDEDLRQVFGQYGDLVSIKIPVGKGCGFVQFANRACAEEALQRLHGTVIRQQTIRLSWGRSPANKQNSQPQGQQPQSDPNQWNGAYYGQGYESYGYAPPPQDPAMYAYGGYPGYGNYNQQVS

SEQ ID NO: 1041 - protein, 66 aa, Pinus radiata
TSYHRPCFKCCHGGCVISPSNYVAHEGRLYCRHHSSQLFREKGNFSQLSKATPTKGVTENSDTDDK

SEQ ID NO: 1042 - protein, 152 aa, Pinus radiata
VGGGGGGKGSPYRGVRMRKWGKWVSEVREPNKRSRIWLGSYSTPEAAARAYDTAVFYLRGPSATLNFPEEARKEQQSDLRLSQLGELSPSSIQRRAAEVGAAVDHAMQAGPVPAQTLREINQENDMKNALSSKLSEGNNFKIEAKNNMRQQG

SEQ ID NO: 1043 - protein, 193 aa, Pinus radiata
MAFAGTTQKCKACEKTVYLVDQLTADNSVFHKSCFRCHHCNGTLKLSNYSSFEGVLYCKPHFDQLFKRTGSLDKSFEAIPRASRNDKMHENENRTPSRVSALFSGTQDKCVACGKTVYPIEKVAVDGTSYHRPCFKCCHGGCVISPSNYVAHEGRLYCRHHSSQLFREKGNFSQLSKATPTKGVTENSDTDDK

SEQ ID NO: 1044 - protein, 121 aa, Pinus radiata
MVKPLPKQSSPSGSENCQIKSRQFKGIRLRKWGKWVSEIRMPNSRAKIWLGSYDSPEKAARAYDFALYCLRGSKATFNFPDSPPEIPCASDLSPPQIQAAAARFATEDFRLPSEEDAASSS

SEQ ID NO: 1045 - protein, 131 aa, Pinus radiata
MEIRLQQENDQDIAPPHEDRVSRQFKGVRPRKWGIWVSEIRMPRSRQKIWLGSYKKPEQAARAYDAAVYCLRGSNAKFNFPNSVPDIPSASSLSRQQIQLAAAKYALDQSPSSPPSLNNNKEEPASPSQSS

SEQ ID NO: 1046 - protein, 102 aa, Pinus radiata
MTQQTTSPTVSPAALALPTSASSTSAKSAAVPVPAQANPRKRPRSDLSAEEKREARAHRNRIAAQNSRDKRKQQFTSLEQRVIDLENENRQLRDALATSQPN

SEQ ID NO: 1047 - protein, 66 aa, Pinus radiata
LLTIFEAVYVHKGIVNAAKVLNLTPSAISQSIQKLRVIFPDPLFIRKGQGVTPTAFAMHLHEYISQ

SEQ ID NO: 1048 - protein, 106 aa, Pinus radiata
MKGPQGISNAQNTCTKFRMPTSENLIPIRLDIEIDGLRLKDAFTWNVNDPDSEIHLFARRTIKDLKYPGSFITPVVQSIQAQLAEFRSFEGQEMNTGQKVLPLKLP

SEQ ID NO: 1049 - protein, 134 aa, Pinus radiata
MEGSQNGSSNAPPPFLTKTYDMVDDPATNAMVSWSPGSNSFIVWNPTEFSRVLLPTYFKHSNFSSFVRQLNTYGFHKIDPERWEFANEGFLRGHRHLLKNIHRRKPVHSHSQQKGESLSGGSCVEIKQLEDETE

SEQ ID NO: 1050 - protein, 220 aa, Pinus radiata
MVLYELLHVQQIQQIQQQQFQLQQQQIAAAASIHHMGRNPLGPRDQPMKLHGSSLSKPAKLYRGVRQRHWGKWVAEIRLPRNRTRLWLGTFDTAEEAAMAYDKAAYRLRGDYARLNFPHLKHHLEANSFAPWTGNSVLPSSVDAKLQAICQSLKQPLESMSKTEESEEISCAYENSGSLGSVRDEDAKKNDVVSVKSETCDSDSSDDSTITALNSSGDQN

SEQ ID NO: 1051 - protein, 219 aa, Pinus radiata
RIEAPGRRTNPAAVTWAAAHFSVKEQDRFLPIANVGRIMKKALPANGKVSKDAKETVQECVSEFISFITGEASDKCQREKRKTINGDDLLWAMTTLGFEDYVEPLKIYLHKYREMEGEKVSMAKQGDPTPSKEGNNAINGSSIENPNANAYSGLNPGGYNRVQSQSLPHMQQAAYGQPPGGMVYGHHGHIMGAYNMTAPNSSGGNSSGQQQQQAPRGQW

SEQ ID NO: 1052 - protein, 100 aa, Pinus radiata
GCTTVVETLAKWQELNSQVESSKDGAKRLRKAPAKGSKKGCMKGKGGPDNGRCNYRGVRQRTWGKWVAEIREPNRGSRLWLGTFSSAEEAARAYDQAARV

SEQ ID NO: 1053 - protein, 117 aa, Pinus radiata
MEIVGKAKEDVSLPKATMTKIIKEMLPAHVRVTRDAQDLLVECCVEFINLISSESNDICYKEEKRTIAPEHVLESLKILGFGSYIREVKAAYEQHRIENWDCPRAGTRWSKNRLEMT

SEQ ID NO: 1054 - protein, 161 aa, Pinus radiata
NINGVAGGVAKEKKVNFPWCALEKQVGTSSFDPNLASSKQAMDSLIMQQLPTFLQYCKDLEEGRQSWFMHKKEATWRLSRLEQQLESEKARKRREKIEEVGSKIRALREEEITYLDKLETECREQLSSLQRDAEMKEAKMMELWATKHLQLTKFVDSALSV

SEQ ID NO: 1055 - protein, 396 aa, Pinus radiata
MARETNSFALLGGDDDQGDDDLMALINSAATLKPEKKPKTTAKKNGQQQPPPPQSQPAKLPSKPLPPAEAVRADRGRGRGGRGRGGGRGSRFEGGEYNTESNGYGGGGGFGGGRGWGRDEDSGNRGWGREEDTGGRGWGRSNGEEDTGGRGWSRSNGEDDAAAGGGQSRGRGRGRGRGRGFGGRGSGRFGGGGDSYGYDANGQDRPPRQQFEDTNTFTGTDNWDTPEVSVVDEAKNVEPEQKKPEEEATPGVTSENKDNKEEEDNEMTLDEYEKLLNEKRKTLEALKNAERKVILDRDFEKMQLVDKKNDGIFIKLNSEKERQRKKETLEKEERARKSVSINEFLKPADGERYFTPSGTRGRGRGRGRGRGDGVSTRGGFGGRYSDADQVAAPCIE

SEQ ID NO: 1056 - protein, 120 aa, Pinus radiata
TWAQEEEKSPRAIGGEKGGRGLRQFSMKVCQKVESKGRTTYNEVADELVAEYANPNSALISPDQQQYDEKNIRRRVYDALNVLMAMDIISKDKKEIQWKGLPSTSPNDLEDLKAKRMGLR

SEQ ID NO: 1057 - protein, 78 aa, Pinus radiata
PMKLYRGVRQRHWGKWVAEIRLPRNRTRLWLGTFDTAEDAALAYDHEAYKLRGENARLNFPHLFLNKGSTSPKACSVA

SEQ ID NO: 1058 - protein, 171 aa, Pinus radiata
SFSCRIRHQTEPTLILIDTAGCDMEEKKDDEDSTMNEGEATVTLMHAKKLLESGVNPSDIGIITPYAAQVGLLKIMRSKEMKLKDLEISTVDGFQGREKEAIVISMVRSNAKHEVGFLNDRRRMNVAVTRARRQCCIICDTETVSSDKFLKRLVEYFEEHAEYLSASEYLT

SEQ ID NO: 1059 - protein, 94 aa, Pinus radiata
EKCSDQVSGSTSSCRIRHELGYSRSAKRCKEKWENINKYFRKAKESNKKRPENAKTCPYFHQLDALYKKRNLGNRHNKIMVLSIFSVASTGLFM

SEQ ID NO: 1060 - protein, 174 aa, Pinus radiata
MAPSNNRRDDNGARGVHFRGVRKRPWGRYAAEIRDPWKKVRLWLGTFDTAEEAARAYDTAAISLRGPKAKTNFAYSSPSSSSSLHNNQSSSQNSSTVESWPSAAPVTRSGDLELPASFLPRLGVSTGRRVLNGGNPRSGRRRSLSEKNSGRKAEGAEARTTLSDSDSSSSAVLD

SEQ ID NO: 1061 - protein, 121 aa, Pinus radiata
MGPLMGSPLGGGLGLSPRMGGGIGNGLQGGLGVGLAGLGATALTIGAASPANQLSSDGMGNSHGDNSTVSPIPYGLDVSVRGRKRGGPVEKVVERRQRRMIKNRESAARSRARKQAYTVNW

SEQ ID NO: 1062 - protein, 145 aa, Pinus radiata
ETRGGSSGDFLPPPPTTKCSEELQNKITKYIALKSAGRSFNKELRNSKGYRNPDFLQRAVKYQGIDQIGSCFKKEIFDPHGYDPSDYYDALALELKREFERREQEKQKNQRVDFVHGAVQTTSVQSVSKPIVQVMGGQKVPVVGV

SEQ ID NO: 1063 - protein, 236 aa, Pinus radiata
MSSPQSNKWLSYFDEPLLDDVGVGQPANPFFWCGQGINDQPDVSVEIDGPNKDMDEQDKLCPRKRSREESSGGPGSKACREKMRRDRLNDRFMELSSVLEPGRPPKTADKATILSDAARVMTQLRTEAQNLKAENERLQEAIKDLKAEKNELRDEKLRMKAEKEKLDQQVKAMALPTGFVPHPAAFHAAAAFAAQSQAAANKTMPVPGYPGMAMWQWMPPAVVDTSQDHVLRPPVA

SEQ ID NO: 1064 - protein, 145 aa, Pinus radiata
MGSRTMLSSNGGRTPQFQPLVRQNSLYNLTLEEVQNQLGDASKPLSSMNMDELLKNIWTQEESQAISMAIGNGPMNGVPPNSAPASGGLQRQGSLTIPRTLSRKTVDEVWRDIQQSQGKSNEEKKPQQRQSTFGEMTLEDFLVKA

SEQ ID NO: 1065 - protein, 171 aa, Pinus radiata
MASGNVDPDQWEFANEDFLRGQRNLLKNIHRRKPMHSHSQNPQQGVCNDAIKYELEEEIQRLKRDKGLLMMELVRIRQQHQGTEMHMQTLEERLQAMEHRQQQMMAFLAKAVQKPGFVAQLVQQSENNKLLEAANKKRRLPKQENCSEAGETELTDSQIVKYQPASGDECS

SEQ ID NO: 1066 - protein, 112 aa, Pinus radiata
VAAASASASGTAVAASLPVNGAAGVRSSVDSEHSDIEASFKEAECSQAIVERRPRKRGRKPANGREEPLNHVEAERQRREKLNQRFYALRAVVPNVSKMDKASLLGDAISYI

SEQ ID NO: 1067 - protein, 73 aa, Pinus radiata
LYAEESSTVTHLQYQQSILENDLRSKLKDNLQQPQNSGKKRRYRGVRQRPWGKWAAEIRDPKKAARVWLGTFD

SEQ ID NO: 1068 - protein, 203 aa, Pinus radiata
NMAKHTVCASFLNEGDFICPPYEDGIGLEWLSDFVEDSFAATGSSNSGSLADLSKDKIDDNREKKKQNPTDEAIIPEIPPIKETPRSQRAVPGRARSKRRRSSGAPIRGWSTSEDYALQNEGGMKTVTGADAINHYQSSAPQQQPRRCTHCLSQRTPQWRLGPLGPKTLCNACGVRFKSGRLFPEYRPAKSPTFIRYIHSNSH

SEQ ID NO: 1069 - protein, 190 aa, Pinus radiata
GNAARRPHDVLLKLEKLSSQTTLESLQRLIVQKKCLLFGKKVGIRIDGKKTANTEKVNERNTIPRIIFGALTFTRNRPHALSKNGSIADTRRNICGAPQEDGTICTAIPLKSRKRCPDHKGQKGQKEKNLSKINISANVESRNQGVGEHENEYRYCGVLLKDGSTCKIIPDKGRKRCNIHKGMRIPGQAK

SEQ ID NO: 1070 - protein, 81 aa, Pinus radiata
MATSNPFDLLGDDDNGDVSQLVFVPQEKPTVKKASQPAQTATAKLPSKPLPPAQAVRESRNGVGRGGRGGRGGDRNQDVGY

SEQ ID NO: 1071 - protein, 154 aa, Pinus radiata
MNREKLMKMAGAVRTGGKGTMRRKKKTIHRTTTTDDKKLQSTLKRIGVNAIPAIEEVNIFLEDSVIHFQNPKVQASIAANTWVVSGSPQTKRLQDLLPGIINQLGPDSFANLRKLAQQFQKEVPHPAVEEDDDDVPELVEGETFEEAAKQESAA

SEQ ID NO: 1072 - protein, 63 aa, Pinus radiata
MPHQHQHQERFPSQEGISWKRDDELPQPQNPPKKKRYRGVRQRPWGKWAAEIRDPKKAARVWL

SEQ ID NO: 1073 - protein, 331 aa, Pinus radiata
MGQIGGPHGYPNSSPSAQDALYEELWHACAGPLVTLPRIGERVFYFPQGHMEQVEASTNQGADQHMPLFNLPYKILCRVINVQLKAEPDTDEVFSQITLLPEAEQDESSVEKEPLTPLPPKPLVYSFCKTLTASDTSTHGGFSVLRRHADECLPPLDMSQQPPSQDLVAKDLHGVEWRFRHIFRGQPRRHLLTTGWSVFVSSKRLVAGDAFIFLRGENGELRVGVRRAMRQQNNVPSSVISSHSMHLGVIATASHAVTTKTMFSVYYKPRTSPSEFIIPYDQYMESMKINFSVGMRFKMKFEGEEVPEQRFTGTIVGISDADPVNWPNSKW

SEQ ID NO: 1074 - protein, 113 aa, Pinus radiata
MTQATNYTAGTIRDDQEEQCVRRGPWTVDEDMSLIRCVTTRGEGRWNTVAKFAGLKRTGKSCRLRWLNYLRPDVKRGNITPEEQLLILELHRLWGNRWSKIARQLPGRTDNEI

SEQ ID NO: 1075 - protein, 44 aa, Pinus radiata
MAENYGSPDSSPRSENESGGGHMGGSDFSVKEQDRFLPIANVGR

SEQ ID NO: 1076 - protein, 282 aa, Pinus radiata
MPMLAETYRDSFETTSGGSSVDLVGMALPGLAPNLSSASVSASASEDSAKKIRKPYTITKSRESWSEQEHDKFLEALQLFDRDWKKIEAFVGSKTVIQIRSHAQKYFLKVQKNGTREHVPPPRPKRKASHPYPQKASKNVPVSQQVSTAFPTAATQLDSGYYPRAESSSILTKSGSSCPTVSSWVHHTIPSIDASFVEKDDGGPPGIETGNNCSSGSTESSPPTWPPCSEIPEKVKPDFSQVYKFIGSVFDPSTTDHLKKLKEWIQLILKLCCTHEEPFHNL

SEQ ID NO: 1077 - protein, 104 aa, Pinus radiata
MGRSFSCWSCSKDNGHERLNRGSWSAEEDTILSEHIKTHGVGRWTSLPKKAGLKRSGKSCRLRWFNYLRSDIKHGNISPEEEELLIRLHRLLGNRWSLIAGRLP

SEQ ID NO: 1078 - protein, 93 aa, Pinus radiata
MDRDKLMKMAGAVRTGGKGTVRRKKKAVHRATTTDDKRLQSTLKRLGVNTIPAIEEVNIFKDEMVIHFINPKVQASINANTWVVSGSPQTKNL

SEQ ID NO: 1079 - protein, 118 aa, Pinus radiata
MDRDKLMKMAGAVRTGGKGTVRRKKKAVHRATTTDDKRLQSTLKRLGVNTIPAIEEVNIFKDEMVIHFINPKVQASINANTWVVSGSPQTKNLQDLLPGIINQLGPDNLINLKKIAQQ

SEQ ID NO: 1080 - protein, 191 aa, Pinus radiata
DDEEEASLKGKVRWGLDSIAALGLKFIKRALAKKKTVGIAGGADRVLLSGRMKLKPKGLMCVFCGLLRVRGNGIIGVKVFLEKYAGSSQQEILRVEISLSFAFQNEDRLLPAASGRGKEESQFRAMACMCWATCVPTCCWEPCCIFSSRSQAGGCLNKQEVDAHIPNYPNLPPQLICHYTMLLCRQMWRQM

SEQ ID NO: 1081 - protein, 86 aa, Pinus radiata
IDSSEKRLKGKNYIDITTERAAQEPGCIMARPQRYRGVRQRHWGSWVSEIRHPLLKTRIWLGTFETAEDAARAYDEAARMMCGPRA

SEQ ID NO: 1082 - protein, 119 aa, Pinus radiata
MVRSPCCDKVHTNNKGAWTKEEDERLIAHIEAHGEGSWRSLPKAAGLLRCGKSCRLRWINYLRPDLKRGSFSEEEDDLIIKLHSLLGNKWSLIAGRLQGERTTKIKNYWNTHMKRKLLS

SEQ ID NO: 1083 - protein, 128 aa, Pinus radiata
MGRSPCPPKEALNRGAWTGMEDTILTEYIRVHGSGGWKDISKRAGLKRCAKSCRLRWLNYLRPDIKRGNISPEEEELIIRLHRLLGNRWSLIAGRLPGRTDNEIKNYWNTHMSKKPWLSMDESQSNTS

SEQ ID NO: 1084 - protein, 126 aa, Pinus radiata
EEEDEEEAGKELEAWERAYADERSWETLQEDEEGLLNFDKKQQQQQQRQYRRRLQSAAAAASNIQRGLIRYLYIIIDFSRAAAEKDFKPNRMVVVANCVEAFVREFFDQNPLSQLGIVIIKNGVAH

SEQ ID NO: 1085 - protein, 139 aa, Pinus radiata
RAPCCEKTHTNKGAWSKDEDEALVAYIQAHGEGSWRSLPKAAGLQRCGKSCRLRWINYLRPDLKRGNFSPEEDEIIIKLHSMLGNKWSLIASKLPGRTDNEIKNYWNTHIKRKMLERGLDPSTHLPLMSDHGSFESSSK

SEQ ID NO: 1086 - protein, 189 aa, Pinus radiata
KVVPPLDFTQQPPAQELTARDLHDNEWKFRHIFRGQPKRHLLTTGWSVFVSAKRLAAGDSVLFIWNEKGQLLLGIRRANRPQAVMPSLVLSSDSMHIGLLAAAAHAAATNSRFTIFYNPRASPSEFVIPLAKYVKAVYHTRVSIGMRFRMLFETEESSVRRYMGTITGISDLDQVRWPNSHWRSVKVGW

SEQ ID NO: 1087 - protein, 132 aa, Pinus radiata
WEFANDCFRKGEKQLLCEIHRRKSVQQSSAAPASRCVSPVNSVEEQALSSTSSPVSSHAEAALVNCGQNSTSGLHGENEKLRKDNLLLMSELAQMKKQCNDLLLFLSKCVNITPDNLSNILIAASQTNCRDE

SEQ ID NO: 1088 - protein, 214 aa, Pinus radiata
GKWGVPDNLYGAQEDSGGSSVKQKNLKDGDQFTSSDEADSEVNEFNIMKRSNSGVGYEDNKRSGGQGDGNQYRSRHSRSISMDSIMSKMHNFSEDLEQEPSQGRNVRHSHSNSMDGSTNFNVEFGNGEFSASEMKKIMASEKLAELATVDPKRVKRILANRQSAARSKERKMRYISELERKVQTLQTEATTLSAQLTLLQRDQLDWAVRTTSSS

SEQ ID NO: 1089 - protein, 97 aa, Pinus radiata
MADGHQFNNILLVGRGGTNPGQLRIHSGGIVWRRQGGGKVVDVAKNEVKSLSWTRVPRGYQLGVKLKAGLNIKLAGFREQDVGNLTNFMTNTIGLAP

SEQ ID NO: 1090 - protein, 108 aa, Pinus radiata
MGDHSGGESSPHSDIESTGIHNNGSSSSSQSIIREQDRLLPIANVGRIMKKTLPTNAKISKEAKEIMQECVSEFISFVTGEASDKCHKEKRKTINGDDILWAMTTLGF

SEQ ID NO: 1091 - protein, 90 aa, Pinus radiata
RNIQRNEYHNLFNFISSKGLKIMNLGDAHGTSGVAAVLENSDDEAVDPHLERIKSAREGGAGEDSDEEACYTGDLSLICAVVKELICTHD

SEQ ID NO: 1092 - protein, 133 aa, Pinus radiata
MGCVSSKVENEELVKRCRDRRRLMKQAVNSRHNFAAAHIAYLRALQNTGNALVQFAEGESSAMNGNAIEEAATPMPATPLTASHRHPMKFHPPPPPPPPPLVPSSPSVSPSMESFRMPSKHNPLSRSTSDISY

SEQ ID NO: 1093 - protein, 148 aa, Pinus radiata
MGRAPCCTKVGLNKGAWSAEEDSLLGRYIQTHGEGNWRSLPKKAGLRRCGKSCRLRWLNYLRPCIKRGNITTDEEELIIRMHALLGNRWSIIAGRVPGRTDNEIKNYWNTNLSKKLAVRGIDPKTHKKITTDGTNRVNGDRFSQRKGE

SEQ ID NO: 1094 - protein, 107 aa, Pinus radiata
RQLIRELEQMFNIEGELEDPSKGWQVVYTDNEGDMMLVGDDPWQEFCSIVRKIYIYTREEVEKMTPQTPSANSRDVQKSLSQEETSRSSDRQDSSIAGVTAERSSDA

SEQ ID NO: 1095 - protein, 275 aa, Pinus radiata
MSNGRLCEDLDRIKGPWSPEEDASLQRLVQKYGPRNWTLISKGIPGRSGKSCRLRWCNQLSPQVEHRPFTPSEDAAILQAHAQHGNKWATIARALPGRTDNAIKNHWNSTLRRRCRDPKKGIVVHLDDEISSLDAARKRSSDGFSHDGSSALEDNGCSSWEVDSKRLKRLGELGTEQGPEVEAEVEVSDRSDANPGRVLYRPVPVVSFFSSFGKTVANLQETAAGAVGVDPPTSLSLSLPGLDPAIPSPKLSTQKDSHNNSTVNNNIPIPPVVNT

SEQ ID NO: 1096 - protein, 128 aa, Pinus radiata
EFGRSSEKGRGYGRGRGRGGRGGYGNDAGDESQRPRRQYERRSGTGRGYEVKREGAGQGNWGTPTDQGFTEEPEELSRAEEEKTVTPEKQEEQKPSEESNQEIPAPESEEKKEEEEDKDMTLDEYEKV

SEQ ID NO: 1097 - protein, 135 aa, Pinus radiata
AVNSSLSVGMRFKMRFEGEESPERRFTGTIIGMGEVDNVRWPESKWRSLKVQWDETSVVPRPERVSPWEIETFVASSAALNPLPAPRTKKPRPNLVSSSQELMIHGSGKTATDSSQVHRLPRVLQGQEMRTFGGS

SEQ ID NO: 1098 - protein, 46 aa, Pinus radiata
AKSCRLRWLNYLRPDIKRGNISPEEEELIIRLHRLLGNRYVENRGT

SEQ ID NO: 1099 - protein, 113 aa, Pinus radiata
MGRSPCCSKEGLNRGAWTKREDMILSEYVRIHGDGGWRNLPEKAGLKRCGKSCRLRWLNYLRPDIKRGNICPAEEELIIRLHRLLGNRWSLIAGRLPGRTDNEIKNYWNTHLS

SEQ ID NO: 1100 - protein, 148 aa, Pinus radiata
PYLHESRHLHAMKRARGCGGRFLNTKKLEDSKANVDNGKTPEGHTAQAGSSSGSEVLQSENGNGNSTQELHGACGMSGSQVTSIAQSSENGTTYQYSHTNGAYLNHYQHPHFHISAFHPLSSGGEEGSSAKGGSIISGGSQQRVVVIQ

SEQ ID NO: 1101 - protein, 48 aa, Pinus radiata
MGRSPCPPKEALNRGAWTGMEDTILTEYIRVHGSGGWKAISKRAGECQ

SEQ ID NO: 1102 - protein, 191 aa, Pinus radiata
VTRPGKFRSCQDGYAVRASLKAEDGVLYPLEKSFFFLPKPPTLILHEEIEYLEFERHGAAGTSSMSSHYFDLIIKLKSEQEHQFRNIQRNEYHNLFSFINTKGLKIINLGATETIGGVAAALQNSDDEAVDPHLERIKIYVMVELVLKTATKRMKTLLQKTMMLDLQQMSQKKRDQMQVRVQRSSNLQRKK

SEQ ID NO: 1103 - protein, 106 aa, Pinus radiata
MSPPPSYSMFPNSGMGLNPSVTSSEPSSQVSGSIPHQYSGSEEDPKLTIDERKQKRMLSNRESARRSRMRKQQHLDELRARTAHLRAENSHMLTKFNIASQKYMQL

SEQ ID NO: 1104 - protein, 162 aa, Pinus radiata
RGQPRRHLLTTGWSVFVSAKRLVAGDAFIFLRGENSELRVGVRRVMRQQSNMPSSVISSHSMHLGVIATASHAVTTRTMFTVYYKPRTSQSEFIIPYDKYMEAVNSNLSVGMRFKMRFEGEEAPERRFTGTIIGIGDVDPSRWPSSKWRSLKVQWDETCAIP

SEQ ID NO: 1105 - protein, 115 aa, Pinus radiata
MAQSEEQPNEATVPRPADSHRSIPTPFLMKTYRLVDDPSLNDIISWNEDGTTFIVWRPAEFARDLLPNYFKHNNFSSFVRQLNTYGFRKIVPDRWEFANEFFRRGEKKLLCEIHR

SEQ ID NO: 1106 - protein, 37 aa, Pinus radiata
MGRAPCCTKVGLNKGAWSAEEDSLLGRYIQTHGEGNW

SEQ ID NO: 1107 - protein, 187 aa, Pinus radiata
TRSGSKNSARAPVSGFSMNSNMGVSGGLDESGFSQPPPNFAKMNAPTRTFTKVYKLGSVGRSVDVTRFRGYPDLRAELDRMFGLEGQLENPRSSWQLVFVDKEKDVLLLGDDPWEEFVNNVRFIKILSPPEVQQMSQEDMEFWSSIPTQQQTSSSSDDCVARNSSRNIRSVLTSPGSLDVLSVDPIV

SEQ ID NO: 1108 - protein, 130 aa, Pinus radiata
HDNEWKFRHIYRGQPKRHLLTTGWSVFVSAKRLSAGDAVLFIRNEKGQLLLGIRRANRSQTVMPSSVLSSDSMHIGVLAAAAHAASTNCRFTIFYNPRASPSEFVIPLSKYEKAVYHTRVSIGMRFRMLF

SEQ ID NO: 1109 - protein, 81 aa, Pinus radiata
MGRTPCCEKGHTNKGAWTKEEDDRLIAHIRAHGEGRWRSLPKAAGLMRCGKSCRLRWINYLRPHLKRGNFSEEEDEFIIKL

SEQ ID NO: 1110 - protein, 146 aa, Pinus radiata
MGRAPCWDKMGVKKGAWTLDEDKILVDYITKHGHGNWRALPKQAGLLRCGKSCRLRWTNYLKPDIKRGNFSPEEEDQIIKLHELIGNRWSTIASYLPGRTDNEIKNVWNTHLKKRLARMKADSVAVDAQPTPASSLASSTTEMTCH

SEQ ID NO: 1111 - protein, 72 aa, Pinus radiata
CIEANGGGAPGRSLPKAAGLQRCGKSCRLRWINYLRPDDVKRGNFTEEEDDLIIKLHSLLGNKWSLIAGRLP

SEQ ID NO: 1112 - protein, 112 aa, Pinus radiata
MRRLRCEKGNTNKGAWTQQEDARLIAYIRAHGEGGWHSLPRAAGLLRCGKSCRLRWINYLRPNLKRGNFSEEEDDLIIKLHNLLGDKWSLIAGRLPGRMEDQIKNYWDTHFK

SEQ ID NO: 1113 - protein, 148 aa, Pinus radiata
GKEVHIAEPDQVSDPPKAIKYEPPAVSCDQEKPLQKLSKETQVKQHGNPTRSCTKVHKQGIALGRAVDLTKFEGYEELICELERMFNIEGELRNPSKGWQVVYTDNEGDMMLVGDDPWQEFCSIVRKIFIYTREEVEKMTPQKHAKLQ

SEQ ID NO: 1114 - protein, 273 aa, Pinus radiata
ETQSSDNNYMVGFVLANVVGLQYYTGTINGREMIRLVREPENRYDPNAIKVLNMSGQQVGHIERAVALALASHVDQSLILIEGIVSRALHKGAYKLPCQIYIFSHRDSMGMVLQLLKGAGLNVITAEDQEFLTAESIAAKEIYEDPGVKEVRRVDDIFGSLNNPKKRQSMEACELVTSTLLQHQKEALAWMVQRENSSELPPFWDVCDKTSKSQQLRYKNVLTNFETNGRPKPLRGGILADDMGLGKTLSLLSLIATNRPGAKLPPVVDIAPS

SEQ ID NO: 1115 - protein, 129 aa, Pinus radiata
LIPQHNAFSLELRFSDRQLPSSTPPNCDSMFPSHYTALALRRQMWRNPRESGQSHSQPPEKDRGKTFGQFKGIRMRKWGKWVSEIRMPRSKERIWLGSYKTVEQAARAYDAALYCLRGPNAKFNFPNSV

SEQ ID NO: 1116 - protein, 90 aa, Pinus radiata
MDREKLMKMAGAVRTGGKGTMRRKKKTIHKTATADDKRLQSTLKRIGVNNIPAIEEVNIFKDDHVIHFANPKVQASIAANTWVGSGHRKQ

SEQ ID NO: 1117 - protein, 33 aa, Pinus radiata
GKTQMKLKRERDQQARDASKRRNGLLKKAYELS

SEQ ID NO: 1118 - protein, 107 aa, Pinus radiata
MGRAPCCANGDRSKGAWTKEEDDRLTQYIQAHGEGCWRSLPKAAGLLRCGKSCRLRWINYLRPDLKRGGFSEDEDDLILKLHALLGNKWSLIAGRLPGRTGHQNQNY

SEQ ID NO: 1119 - protein, 112 aa, Pinus radiata
RKSNVHSFCKTLTASDTSTHGGFSVLRRHADECLPPLDMSQQPPSQELVARDLHGMEWRFRHIFRGQPRRHLLTTGWSVFVSSKRLVAGDAFIFLRGESGELRVGVRRAMRQ

SEQ ID NO: 1120 - protein, 156 aa, Pinus radiata
ALREAIKNGACPNCGGSTSLGEMPGFDEHHFRIENTRLKEELDRVSGIATKYIGRSMPHLAPIATPPMLMSSLELAMGSFGGKQSQPAAPSVDFISGPLADGPIINCGTLTDLDKPLALELAMNGVEELIRMAQTDEPLWLKDVNAGSVKELFELG

SEQ ID NO: 1121 - protein, 116 aa, Pinus radiata
GFFIFMCRLPGRTLANGRLIWLCQANEADSKVFPRALLAKSASIQTVVCIPLADGVLEFGTTEVEREDPGLVQRTISFFLEYPKPICSEQSTSSPQCSDRDEKDQVGMVTIMSSDS

SEQ ID NO: 1122 - protein, 104 aa, Pinus radiata
FLFDSLDAVNINMEAVHKIEKFLLAPKIDATISSAAAPPWKTLFAAAGFSPVAFSNFTETQAEYLIQRLHSRGFEVEKAHAALLLGWQGRPLVSATAWRCGPPP

SEQ ID NO: 1123 - protein, 169 aa, Pinus radiata
EEKQLSISGRNWGEVNLEGNMLTFLVGSKPAFEVSLADVSQTQLQGKNDVVLEFHVDDTTGANEKDSLMELSFHIPNSNTTFAGDEASPPAQIFREKIMSMADVGSSGGEAVALFEDIAILTPRGRYTIELHLSFMRLQGQASDFKIQYSSVLRLFVLPKSPHTLVVIT

SEQ ID NO: 1124 - protein, 124 aa, Pinus radiata
LGHSQNFSTDVNRMPDVPPRRGGHRRAQSEIAFRLPDDIMFDGDLGFAGFDMPTVSDDATEAEDLISMYMDMEKLTSFGEPLNSAAGEGSKLPSGAETNRPPHHSRSLSVDAVFSGFEGNMEDT

SEQ ID NO: 1125 - protein, 70 aa, Pinus radiata
MDRSSSEDSVDSQGDVNANYKMVFSEDEKDLISRLYNLLGQRWALIAGRIPGRTAEEIEKYCSRRYISEY

SEQ ID NO: 1126 - protein, 120 aa, Pinus radiata
GGEIRILRGFFVNQKTDGQGSSFAASSSRNSSFSNGYDNPQNTNKNSSSGGTGDAGSFECNICLELAQDPIVTLCGHLFCWPCLYKWLHGHSKSQECPVCKALVEEDKIVPLYGRGKVGS

SEQ ID NO: 1127 - protein, 233 aa, Pinus radiata
MGAPKQKWTSEEEGALKAGVEKYGTGKWRTIQKDPEFGHCLAARSNVDLKDKWRNMSVSASGQGSRDKVKTPRVKAIASLPYSSVTAESTSVFSIEATTSTTPDNLISPKSSSNGKIHSPRYDGMILEALTSMQDPNGIDIATIASFMEERHELPPNFKRALGTKLRRLVAQEKVIKIRNSYKLKDMTSTEVTSEVLGSAIPIDNSMQYSNAFTNTIDTFSVDRVNEASMAAA

SEQ ID NO: 1128 - protein, 144 aa, Pinus radiata
HSRPLIKEEAESGDNSANSADVETLLPQVDETASADLTVFPGFVTPYVPYGFPIWHTFRPTITQTSNVYKPTAVMPTAPIKMDECTGLSQLSLGGVAAASAMKPSELSLKLHGRPPSRQSAFQAKPSLNESSSLSSSSNVISVV

SEQ ID NO: 1129 - protein, 187 aa, Pinus radiata
HPYMWGGQPLMPPYGTPLPYPAMYPHGGIYAHPSMPPGALPYGHYGMPSPGNAEVTTTLALPNAEAEAKSSEGKERNTMKRSKGSLGSLGMITGKGGEGGKATSGSANEAMSQSGDSGSDGSSEGSEEYNTQTESQVARKRSFDQMIVDGANAQSTNIQSYNSQAGEPYVTSGGHAMGNPISQAVAA

SEQ ID NO: 1130 - protein, 80 aa, Pinus radiata
GKVTASGKVTSGVNDLFWEQFLTETPGSATDTQEAESKIQETRTKDQDERLPENGKCWSNKQTLDQLTEQMGQLASGTQT

SEQ ID NO: 1131 - protein, 96 aa, Pinus radiata
MNMDSRQSGEEEDCNVTRPGGGGGISLHVSSVEYCQKSACVAHDISSDEQDLINRLHNLLGDRWALIAGRLPWRRREEIENYCKMRYTATTSSSRS

SEQ ID NO: 1132 - protein, 193 aa, Pinus radiata
ERERGRKPANGREEPLNHVEAERQRREKLNQKFYELRAVVPNVSKMDKASLLGDAAAYIKDLFSKQQDLESERVDMQVQIDTIKKELLMNSLKLAAKEAKDLSSIDLKGFSQGKFPGLNSEVRIVGREAIIRIQCTKHNHPVARLMIALQELDLEVLHASISTVKDSLIIQTVIVKMTRGLYTEDQLHALLCK

SEQ ID NO: 1133 - protein, 88 aa, Pinus radiata
MAYNRKHAAAATSPDSSLGSDNESGGGGGGGGGKGQSTKNGNGNYIREQDRLLPIANVGRIMKRALPGNAKISKDAKETVQECVSEFI

SEQ ID NO: 1134 - protein, 141 aa, Pinus radiata
MATRNPFDLLEDDDNGDPSSLLDTLAAAKDKPAAVAAKKQQPAVSASGKLPTKPLPPAQAVKESRVSPNEGGRGRGGGRGGRGFGNRESQEFGRGRGGGYNVERNFNRENNAYSGSRVGFYDNNSDLIPSRNEDGDGASND

SEQ ID NO: 1135 - protein, 43 aa, Pinus radiata
MPRVKLISRNFMDMVAALPAAKLDRLYDKSLHLRSGLRSLTPV

SEQ ID NO: 1136 - protein, 48 aa, Pinus radiata
MAEEMDTPTKTTKTPTSQEQTSTSTPVAYPEWAAPIQALYNSGKTPLP

SEQ ID NO: 1137 - protein, 190 aa, Pinus radiata
SFSSTRESMERRDQSPVAARHPMRKHYRGVRQRQWGKWVAEIRLPQNRTRLWLGTFDTAEAAALAYDRAAYRWRGECARLNFPHLFSKKYQNSSPSSTNGRIPRLSCEKSDQKYAYNGDPVHTNVYKGPPIRITAYNGDPVPIDVYRSDPVRVSAYTGDPVRISAYSGDPVGNTVTLAESELESSCSHES

SEQ ID NO: 1138 - protein, 177 aa, Pinus radiata
LDYMEEQNWDINGAKYDGSEKWKAHSSEQKDLGTIPTKVEGRIGNRENSLDVTRGGALWDIFRREDIPKLQDYLLKHCQDFRHSRNVSVDSVVHPIHDQTFYLNEGHKKKLKEEYQVEPWTFEQHLGEAVFIPAGCPHQVRNLKSCIKVALNFVSPENLQECIRLEDELRLLPKNHR

SEQ ID NO: 1139 - protein, 148 aa, Pinus radiata
GPREMTEEERETKKAASVAATAADQELRKKVLRDLHALINPNATGEADPAEFPGDDATVDGEVTDAEWFYLVSMMKSFGNGLGVPGQAFCGGMPIWIIGSEKLQSYNCERARQAQQFGIQTMVCIPTPNGVVELGSTDLNPQNWDLIQ

SEQ ID NO: 1140 - protein, 341 aa, Pinus radiata
MCGGAIIKEFIPANRSRRVTARELWPDFDTFAEFINGGATQETFNKPGKLDEGCKQKSKPSKGSVKTQQEFCSGFEGGRSEVIPPLEDVEGSTPTIGGRKRKNVYRGIRQRPWGKWAAEIRDPSKGVRVWLGTFNTAEEAAKAYDAAAKRIRGKKAKLNFADNSCSVKNDTSKKLSGKKGKLCSKHPALLLEGFNASCKVKPSYSANPDLLGGYNINRKVKASLSGVGKSDLTICGYDDMEYGDSGFSKPSAPFQNNSNACTVQFSEHSNLTQTSQKSCSCEICSHNYSEMSNVMPPAYGNAVNFEPVQTSNPGGYFDSDHSSMSFEGAHFPWAQEIKTPE

SEQ ID NO: 1141 - protein, 181 aa, Pinus radiata
AKTLHPCWDAYQLEDERASAVYINVFSGDATTEFPSALQLGRGGILADAMGLGKTVMTISLLLANSGKGGFSGMDTVEPFSANSCSEKTIIHPYNIGVELGPSQYTNKTQGTSMLRRSSSGLHKGGGNLIVCPMTLLSQWKTELETHVQSGTMSVYVHYGQSRTKDVKSLLQHDVVLTTYG

SEQ ID NO: 1142 - protein, 59 aa, Pinus radiata
MFVGMMSEVGSPTSQDSRNSEDGERENCAVREQDRFMPIANVIRIMRKVLPTHAKISDD

SEQ ID NO: 1143 - protein, 133 aa, Pinus radiata
MGFEQTRGGGGGAKMTQHQVVTTELVRQATERLRKLCRTGVKVELRDFFQLCIVLAKSIDSAVVYNQIPTMVHELPQLVRQVFERKDDIRLQPAIMVLMLSVKNACRSGWFRVTDTDELLTMSKELSSRFTST

SEQ ID NO: 1144 - protein, 169 aa, Pinus radiata
MTRKCSHCGNNGHNSRTCPNRGGVKLFGVRLTDGPIRKSASMGNLMMMSNPSSPADPSEPASAAAAAAAAAASGYLSDGLVEASTSSNSRERKKGVPWTEEEHRMFLLGLQKLGKGDWRGIARNFVITRTPTQVASHAQKYFIRQSNMTRKKRRSSLFDMTPVSFFFLS

SEQ ID NO: 1145 - protein, 103 aa, Pinus radiata
VSSRHEFAVSQMAYLQALRNAGATLRQFAELESMELQKTSPYPHLRHYRVTLPPSPPPLPPPPPPPPPLSLTPSPSYGSATFPSSIPVNRSIYRCPYQQCSPS

SEQ ID NO: 1146 - protein, 153 aa, Pinus radiata
QLPDEAIALAAASHIERELQITSWNLSCNFVASTLQGRECIERLEITGIGDPSGRGLGFSYLRVAPKPPISSALVKKKAAAARGGSAVTGTDADLRRLSMDAAREVLLKFNVDEEQIEKMTRWHRIAMVRKLSSEQAASGVKVDATALNKFAR

SEQ ID NO: 1147 - protein, 73 aa, Pinus radiata
MKSPSTSCLSHPVEGEQKSINSELWHACAGPLVSLPSVGSVVYYFPQGHSEQVAASTQKVADTHIPNYPNLPY

SEQ ID NO: 1148 - protein, 213 aa, Pinus radiata
LKVQWDEISAIARPERVSPWKLEPSLTPVAVNPLPVARGKRPRPNILPSSSDLSVHDKAPVDSTQVHRFPRVLQGQEVMTLGGSLGDGELESGQKMVAWGGSKLDDVKAEGMGCQRRLVSENWMPPLRHDSLYSDTFSSFQPVGEVQEFRGSLTNSILEDGQQPKLSRKQFQDQEGKIVDGSGLWSMSFPNSLQLCESNRKMSATSAAQSHKQ

SEQ ID NO: 1149 - protein, 217 aa, Pinus radiata
ELTSDSHRQATLQLEAEVTAWHISFCSLIKSQQDYICALYEWARLSLVQLGNEAQWERGNRPPIYTLCDVWQQVLKRLPDKVASESIKSFISVVHAIVMQQADEQKRKKKAENISRELQKKMIALRNIEKKYYSSYSIPARADATTESQFELGHTDPLAEKRAEIEIYKRRLEDEKANYSKSARGTREMTLNNIQTGLPGLFQALSSFSSVCASSFE

SEQ ID NO: 1150 - protein, 33 aa, Pinus radiata
MAMGEAERITGPWSPEEDTSLHKLVEKSGPRNW

SEQ ID NO: 1151 - protein, 127 aa, Pinus radiata
WRPAKFARNLLPNYFKPNNFSSFGRQLNTYGFRKIVPDRWEFSNEFFRKGEKQLLSEIHRRKGLIQPPPPPENRSISPSNSGDEQTWSSTSSPNSSTGVDALSHKNAIEENEKLRKENLLLVSELTQ

SEQ ID NO: 1152 - protein, 104 aa, Pinus radiata
PHGLQHHSSDDANGDGDKRIGVETGSSVCPELWHACAGPLISLPPKGSRVVYFPQGHLEQIADNELHRGGRGSFLNINHAAAPMAEEASSAAALNIPPSFISQP

SEQ ID NO: 1153 - protein, 146 aa, Pinus radiata
ETLTLLKIRSEMDSKFREATHKGPLWDEVSRALAEHGYQRSSKKCREKFENLYKYYKKTKEGKAGRQDGKHYRFFSQLEALYGGTTIDAADSCFGVTTRTNLTESPGLDFNGDGASQKYADTHHNSEGFSLSSDSSSDDEYSHDIQ

SEQ ID NO: 1154 - protein, 105 aa, Pinus radiata
IFYRLHCNLGEKSNKIYICLFTMELADEHSILRYKKPKLSKNVVSERRRRQKMNKLLYTLRALVPNISKMDKASILADAIEYVEKLKQQVERAESDVQSTNVSAL

SEQ ID NO: 1155 - protein, 83 aa, Pinus radiata
REFNINADVYAQDSIELLKQSGIDFEKNEEKGIDSHRFGELLMSSGVVLNENVNWITFHSGYDFGYLLKLLTCQNLPPEESDF

SEQ ID NO: 1156 - protein, 170 aa, Pinus radiata
MANRSLWGGSDFDYENEADTRKGPWTVEEDMQLGIVNLHGEGRWNFLARASGLQRTGKSCRLRWVNYLRPDLKRSKITPEEERLIIELHRRWGNRWSRIAQSLPGRTDNEIKNFWRTRMKGKLNSETQKDIAGVDADDGVQFESELGSCRLPVISSHALPEVDVAEPSST

SEQ ID NO: 1157 - protein, 119 aa, Pinus radiata
GTVGRKRRRIHRSSIGVTGGRGLRHFSMKVCKKVESKGWTTYNEVASELVAEFVNPNSTHLSQDQQQFDEKNIRRRVYDALNVLMAMDIISKEKKEIRWKGLPTTNLSDIERLKTERKR

SEQ ID NO: 1158 - protein, 97 aa, Pinus radiata
CPRAFARAYNLKTHMATHDPNRLKPHVCPHRSCARSFSRKHDLGRHLVSIHRDDSVVSTPSASMKSIGVDSGRRSWCDNCGKGTIGASCQCSCADIK

SEQ ID NO: 1159 - protein, 162 aa, Pinus radiata
HAPIFCRVARNFQLRVILKENRRRETFDGFLREDHEKVSQLVTQHYKVQLETKEISVKGWNWGSTDVQGNDLAFVVANRTAFEVPLRSITNSNIAGRTEVSLEFSTAPAPSASKSKKGRPDELTEIRFYVPGTHTKDDDDEADITKDDEEVSAAQAFHDMIK

SEQ ID NO: 1160 - protein, 163 aa, Pinus radiata
GSGGVKMEDHSPVIINSQSGYCQSQQSSQMPLAGYMSPHGIPIQHTDDAASKETQYLRRRCFNCHTTEPPSWRRSTLTPGKIVCNKCGLYERTHLRPRPLRFDELRAGNKSRKQTKSSPKGAKVIPPGPLPIKKEPAEMEAISRRMSVSSSSSAQSGGGGSSD

SEQ ID NO: 1161 - protein, 148 aa, Pinus radiata
RNLLGARAQPMKLSAKNDSKLGIARPAKLYRGVRQRHWGKWVAEIRLPRNRTRLWLGTFDTAEEAAFAYDTAAYQLRGEYARLNFPDLRYLLLSNSDNGSHNVLSPPGNALSVLKSSVDAKLQAICQRLSQENSSENRLMAHSANNEA

SEQ ID NO: 1162 - protein, 48 aa, Pinus radiata
FLEALEKREEDRMMREEAWKRQEMARLNKDQELRSQERSMAASRDLAL

SEQ ID NO: 1163 - protein, 255 aa, Pinus radiata
VALSNNPLIFSAKVENGTPSYDGLKHANTNPMPFSGLGNVSMGPLFYQANPIQRVKRVRDTSFIMGPPSSPFGRMGVNGHMGMNDVSKSLQPGFKARVPYPLQAARSDSFVAQGCFPYDPNLSSTSNLPLGGFSSGSHAVMNGTFSSSRLFSGQKLELPSSQFAESVQTAGSSINPVLNRSTPLLLPPVPTQTINQVDYSFSTPKNSGLLESMFQEAQTMGGVKAHSSSNSSIDLQGGSKSSISNPLNNGFLCRS

SEQ ID NO: 1164 - protein, 147 aa, Pinus radiata
IRMEEPLQIINSSPIQQQHDHDDDDHGHGHEEEVIPHPLLPPPGDTCIVPYIMPVSTSTAEKHPPQPTNIAFNGPETEEDDKKRDREHKKRSKNWTRVETLKLIKLRTEFEPRFSRSGRKTELWDEIAESLRKEQFFRDAQQCRDKW

SEQ ID NO: 1165 - protein, 202 aa, Pinus radiata
MDQQQPTIPALPQVGYGTNPYIAPPIGGPPHPQLASYHQQLQAFWGNQMREVEQAQDFKTHSLPLARIKKIMKADEDVKMISAEAPVVFAKACEMFILELTLRSWIHTEENKRRTLQKNDIAAAIGRTDIFDFLVDIVPRDEFKDEGLVIPRAAGAVPFMGPGDNVPSYYYVAQQAPNVAAYAPPTQQMRSKAPAPPPHGSS

SEQ ID NO: 1166 - protein, 143 aa, Pinus radiata
QGSLTLPRTLSRRTVDDVWREIHKENIDGNGNAPANQARQPTFGEMTLEDFLVKAGVVREDAEQGDGQSFGAFRNALDGEFVANLAERNGDNRLGIGNSLGLGFGERGHRNGEVGSNKSGAGGVPGLSLSPTNVFLIMLPWIW

SEQ ID NO: 1167 - protein, 90 aa, Pinus radiata
FQRRKKKSIGRGCLKTSINDVEQLKAEKLLLKSRIEKKASYFHELEEQIIGLQNLVKRNEHRYSSGNTPSGGVSLPFILVQTHPRATVEI

SEQ ID NO: 1168 - protein, 105 aa, Pinus radiata
GIRRATRQKSGILSSVLSNQNAHLSVLAAAASAVATKSMFHVFYNPRTSPAEFIIPYQKYVKSCKQPLSIGMRFKMRFETEDTAERRYTGMITAIGDADPARWPG

SEQ ID NO: 1169 - protein, 106 aa, Pinus radiata
QDTHSEPMAMEMGLVIDGDRFSSEGDGDIMLDGEDLLPEINDMFWEQFLAESATSGGTEEAESAAQESLTKDQDEKPSENGNWWKKNQNMDNLTEQMGQLASESNP

SEQ ID NO: 1170 - protein, 144 aa, Pinus radiata
DGAVRDAGRLVPAPFLVKMYRLVDDPSTNHIVSWGENNNSFVVWRPKEFSASVLPCYFNHANFSSFVRQLNNYGFRKTFRGQCEFSNKLFEKGKQYLLCHIHRRRASNSSPMPMEYGKSSLLFPIILPTQHSNVLAAPLPSSLS

SEQ ID NO: 1171 - protein, 62 aa, Pinus radiata
KERILTEENLFLRKKCGDEHVDCSAFRTPPAQLRSIQNIDVETQLVIRPPTVQQHPDVDSPR

SEQ ID NO: 1172 - protein, 88 aa, Pinus radiata
DPNAPKKAMTGFMFFSQVERENLKKSDPGMAFTDVGRTLGERWKKMSAEEKAPYESKARADKERYKEAMADYKSGPTNVDSGNESDSE

SEQ ID NO: 1173 - protein, 106 aa, Pinus radiata
LLFGVNIDSSSLIVPNTVSNMRSIGSSTDAVMQFGVSNYLNAPPCASGSNISLNSDISASACLDESGLLPPAENLGQMNAPTRTFIKVYKQGSVGRSLDISRFSSY

SEQ ID NO: 1174 - protein, 108 aa, Pinus radiata
MATTRHQRSPDSSPRSEDESGAHTYSNQDGSVKEQDRFLPIANVSRIMKKALPANAKISKDAKETVQECVSEFISFITGEASDKCQREKKKTINGDDLLWAMGTLGFE

SEQ ID NO: 1175 - protein, 137 aa, Pinus radiata
KSDYRDSDDEGGGTVREGKDLQTSNFIDYFGQSNHTEEAENEHDASVDTKGPLESSNEVGHPTTYPESSSLSAQGSEPRVFSCNYCQRKFYSSQALGGHQNAHKRERTLAKRGQRIGAFQHRYISMASLPLHGSTES

SEQ ID NO: 1176 - protein, 206 aa, Pinus radiata
SRGKALKLFGFEFRGSEGGSFEGTNGSDQPQDGTNILTAGEASTEPVEEELVIEAKNGDSGKLEDVGSPVEAGESGSTSNCLGSSAQENRKYECQYCCREFANSQALGGHQNAHKKERQQAKRAHLLATRSAAASANRSGATAWCGNINGNLYHRNFLFNNSYFTRMQVFQEDFPTFQTPQAVAAPSIPHYIFSYQQQQQAPVQSR

SEQ ID NO: 1177 - protein, 116 aa, Pinus radiata
VPENSKQIINHGLILPEMGSVDSGREGTRAILSDDCVKFECRYCCRVFPTSQALGGHQNAHKRERRRAMTRFQRSPSDSSNYSGKQNSIDLFSRERVPGSSLLSPHGTRDHVVCSD

SEQ ID NO: 1178 - protein, 122 aa, Pinus radiata
KKASEWGESVVSTSENSNDLDPPTYSETSSPAQGSDPRVFPCNFCQSKFYSSQALGGHQNAHKRERTLARRAQRMGSFAQRYSSMASLPLHGSSETSWTPSRFLGIKAHSLIHKPFPEGDNL

SEQ ID NO: 1179 - protein, 113 aa, Pinus radiata; identical to SEQ ID NO: 1074

SEQ ID NO: 1180 - protein, 76 aa, Pinus radiata
MRRPQRKKKTDAEDDFDECYYTHMCKICKKKFVSGRAFGGHMRIHGPVATAAAAAAESNGKNLEPQRKRSRAEEIR

SEQ ID NO: 1181 - protein, 130 aa, Pinus radiata
VGCKGSDAFEESLKHFCRVCKRRFACGRALGGHMRVHGAELGAIKGGGLEEQFEKGRVKEPSRSCGDSVKEGVQDEVEGLNSMYTLRRNPKRSWRFADQDYSFAFGGVDGSGAKRFGSTFLRDSRVCEEC

SEQ ID NO: 1182 - protein, 86 aa, Pinus radiata; identical to SEQ ID NO: 940

SEQ ID NO: 1183 - DNA, 462 bp, Eucalyptus grandis
  misc_feature (1)...(462): n = A,T,C or G
acaaacaaacaaacaagacggaacgagatgaagacggttcagtcgaagaagttcaggggcgtcagacagcgtcactggggctcttgggtttccgaaattcgccatcctctgttgaagagaagggtgtggctgggcacgttcgagacggctgaggaggcggcacgagcctacgaccaggccgccatcttgatgagtggccgcaatgcaaagaccaacttcccgacatctcaaaccacgaacggcgaccccgccgctgccaattccttgtcttcctcgaagcacttgtcggagatcctccacgcgaantcaaganatgcagcaagacgccgtcgccatccctcacctgcctaaggctcgacactgagaactcccacatcggagtctggcagaagggtgccggccagcgtcagactcaactgggtatgaccgtacagtcggaacaaaaatccgatccattggtag

SEQ ID NO: 1184 - DNA, 340 bp, Eucalyptus grandis; identical to SEQ ID NO: 226

SEQ ID NO: 1185 - DNA, 190 bp, Eucalyptus grandis
cttggggttgacatggcgcgacgtggcggaggaaggaggcgaacggcggctccgaggcgtccgacgccgtcttgccgcgagctcatcatcgccatcgttacaagggagtgaggatgcggaagtgggggaagtgggtggcggagatacggcagcccaacagccgggaccgcatctggctcggctcctacgc

SEQ ID NO: 1186 - DNA, 473 bp, Eucalyptus grandis
  misc_feature (1)...(473): n = A,T,C or G
aacaaaggtntgtgtatggaaccattctggatagcattgcaaaggttactggaattgtgaagtttgatctgcatgctgagccagaggaaggaaaaaagaagattgaggtcggaggaaatgttgcaggtgtgtttgacctaggaccaggtagaattnggttctgaagctgtttttgtccctcgagagcctggcatcacttctgaagaagatgatgggtacctgatattctttgtccatgatgaaagcacagggaagtcggcagtaaatgtaattgatgcgaaaaacatgtcatctgatcctgttgctgtcgttgaattaccccatagggttccttatggcttccatgccttcttcgtgactgaggaacaacttcaggaactggctaagctgtaggtctctacatgcacgaattgttgggaatgcagatgttgcgaggggaggcatatctctggaaagctgctacagttgatcta

SEQ ID NO: 1187 - DNA, 333 bp, Eucalyptus grandis
accagatccagatgcagaggtcattgcactatcgccaaagacgctcatggcgacgaacaggttcgtttgcgagatatgcaacaaaggcttccagagggaccagaacctgcagctgcaccggaggggccacaacctgccatggaagctccggcagaggagcaaggagatcgtcaagaagaaggtttatatatgccctgagaagacgtgcgtgcaccacgacccttcaagggcacttggcgacctcactgggatcaagaagcacttcagccggaagcatggcgagaagaagtggaagtgtgagaagtgctcgaagaagtacgcagtccagtcaga

SEQ ID NO: 1188 - DNA, 420 bp, Eucalyptus grandis; identical to SEQ ID NO: 234

SEQ ID NO: 1189 - DNA, 365 bp, Eucalyptus grandis
  misc_feature (1)...(365): n = A,T,C or G
tgacgccgagcgacgtggggaagctgaaccggctggtgatcccgaagcagcacgcggagaagcacttcccgctgccgggcgggccggcggcgacgatgaagggcgtactgctcaacttcgaggacgtcggcgggaaggtgtggcggttccggtattcgtactggaacagcagccagagctacgtgctcaccaagggttggagccggttcgtgaaggagaagagcctgaaggccggcgacaccgtntgcttccagcggtcgaccgggccggacaagcagctntacatcgacttcaagccgcggggccagccgccggccggcccggccgcgccgccgccgccgcccgtacagatggtgaggctgttc

SEQ ID NO: 1190 - DNA, 434 bp, Eucalyptus grandis; identical to SEQ ID NO: 324

SEQ ID NO: 1191 - DNA, 479 bp, Eucalyptus grandis
gaatcgtttcttggactttcttgagctgctcctttcgcctcatttctcaagtgcgtgaaaaccaaaaaaatggtgagggggaagactcagatgaggaggatagagaacaagacgagcaggcaagtgaccttctcgaagcgtcggaacgggctgctcaagaaggccttcgagctctcggttctttgcgatgctgaagtcgccgccatcattttctctcctactggaaaactttatgagttctctacctcaagcatgagcagcataatagaacgatatcaaaggaaaacaaaggacccggggtgcagcgagaaaactaccgaaatcgatttgcagaatatgaagggaaactctctagacatggcaaagatgatcgaacttctcaacgtttccaacagtcggctctcaggagaactttcagatacgtgttcagttgaggagctacaatcaacacagaacctgttagagagaagcttatccaa

SEQ ID NO: 1192 - DNA, 310 bp, Eucalyptus grandis
ccctcttcctcttcctctccctctctctgtcgcagagctccgtctgaactcgcagaatccacgcgcagagcgacccaagagtgtttcagaacagtccgtccatggccttggaagctatcaactctcccaccgcggcctcagcgccgttccagttcatggaggagcccttgagctcccgcttcttggagcccctgaacaagcgcaagcgctccaagcgcccccaccaccctccctccgaagatgagtacctcgccctctgcctcatcatgctcgcccgcagcggcgccgcccccaagcccaaccaccacgc

SEQ ID NO: 1193 - DNA, 466 bp, Eucalyptus grandis
tttttttttttttttattcaaaaacaaaatctcacttgccctttcttaatatatagtagccaaagccttctggagatcaccttttatcagctaccaccagtcagataggtctattgaatatgcttgattgctcgttcctcaagcatatgcaactacaaagactcccatatcaaagcactagctgcatatacacttttaagctaactaacaagagaatttaaaaagaaaatcctcgctgcaccaaaaaggctcgatccatatgggcaccaaaacaaatagctcacattggcataagctttggaccattatcaggcatgcccatccctgcagctaactcagcatcaagctgagtatgtggcgcaggacccatcatttgcttcatacgtttcttgtggcgcttcgtcttgaaatgctcgtccctcgtagcaacattcggaaaatatcggtcgcagtgcaggcaatagta

SEQ ID NO: 1194 - DNA, 295 bp, Eucalyptus grandis
gccacccaacacacacccaagaaaattcttagagcctccttagatatgcctacagacctggacaattcgtccacagcttcaggggaagctagtgtctcgtcttctggcaatcagccgcctccacaaccaccgccaccgccttccaccaccaagaaaaagaggaatctccctggaatgcccgatccagatgcagaggtgatagctctgtctcccacgaccctattggccaccaacaggttcgtctgcgaaatctgcaacaagggatttcagagggaccagaacttgcagctccaca

SEQ ID NO: 1195 - DNA, 337 bp, Eucalyptus grandis
tccaccctcactcgcgaagtcaaaatcttctagtgtagccatattcttgatgaacattcacacgcaactaccgtcggacgtgcgggtgccgacgccggcgcagtcgtcttcgccgtccccgtcgcagtcgtcgcagtcggagtcctccgcgagccacgccgcgtgctccgacgaggagccggccgtggcgctggcttccagccggcccaagaggccggctgggcggaaggtcttcaaggagacgaggcacccggtgtaccgtggggtgcggcggcggaacaggggcaagtgggtgtgcgagctccgggagcccaacaagaagacccgggtatggctc

SEQ ID NO: 1196 - DNA, 450 bp, Eucalyptus grandis
  misc_feature (1)...(450): n = A,T,C or G
gaatgatgcatgtgatggaccggtaacaggacttgcactgtcaaagtgccgnacgctcatcggtctgccagaaactcacggagagagagagatggcggagagagaggagaaggggaagtacgacgagatgatgatgaagaaggggagcgacgganggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggntcatgggatgcggat

SEQ ID NO: 1197 - DNA, 351 bp, Eucalyptus grandis
ctccagccagcttctgtctcttataaacactagccccaccccattcattatccacttcactccaacccaacagctatcgcactatcccactgcagacgccctcccacgaaccctttctcttctgatccccatcccaactcctgccgcttcgacttccccaagccgtccttctcgtcgccgctgtccaacgggagtagcgccatggcagcccccgggaacttctccgacgaggaggtgcgcctcgcgtcccaccacccaaagaagcgcgccgggaggaagaagttccgggagacgcgccaccccgtgtaccggggagtgcggctgcgtgactcgggcaagtgggtctgcgag

SEQ ID NO: 1198 - DNA, 359 bp, Eucalyptus grandis
agaacacctcagaatcaacaccactccccaatttctctctctaagatcccacacccaaccgccaccctcaatctctctctttctctctcttcttcagtgtctgccatggctttggaggccctcagctcccccaccgctccctccgccccgttccaattcatgaaggactcctcccccgccgccgccgccgccgcctcctcctcctcctccgcctacgacctccccctcgccgagccctgggccaagcgcaagcgctccaagcgcccccacaacccgccctccgaggacgagtacctcgccctctgcctcatcatgctcgcccgcggcggcgccggccggaccctccccccgccgcctcc

SEQ ID NO: 1199 - DNA, 645 bp, Eucalyptus grandis
  misc_feature (1)...(645): n = A,T,C or G
tcgactgagagatcctagtggaaatagaagatttcctgataccatcgatccattcttctccaatggctgcgaatttcgtcattccaaccaaaatgaaggcttgggtgtaccgtgagcacggagacgtcgccaacgtattgggattggacccggaactcaaggtccctgaattgcaagaaggccaagtgctggttaaagttcttgccgcggcgctcaatccaatcgacaccgcgagagtgaangggggttatcaagctcccggcttttctctaccggccgtgccaggttacgatctcgccggcgttgtggtgaaggtgggccgcgaagtaaaggagctcaaggtcggggacgaggtatatggatttatgtttcacgccaagaaagacgggacgctggctgagtacgcagccgtggaagagtcattcttggctttgaagcccaagaagctgcgtttcggggaggctgcttctctgccgtggtcattcagaccgctatggaggccttgaaagaactggcctctctcatggcaagtcccttcttcgtcttaagtggtgctggtggcgtcggcacactcataatacagctagcttaaggaagttttggtgcatcaagagttccagttcattcaacactgggaaacctaga

SEQ ID NO: 1200 - DNA, 376 bp, Eucalyptus grandis
  misc_feature (1)...(376): n = A,T,C or G
tttttttttttttttgtgtactggtgcactatgaattgtgagcattcaatcaaactatatatagacaacattcttccttatataggcgggagcaactacggngttgacagcaaaatttacaaagccagcagctagcacaggatgtcaagattcacctccaaaccgataaagtcgacatggctctattaatccagccaagatatagagccccctccctctgctcgattctgtaattcccgtgatactgcttcagcatatcgagcacagcacgagtaaccgatgcgtccactggtagctgattgaaaccggccatttggaatctggaccgccatttgccgaaaagctcatgcctttccatcctctcangcccatcaca

SEQ ID NO: 1201 - DNA, 461 bp, Eucalyptus grandis
cgacaccgaccagggtgttcatgtattgtttgtatacaaccccccagtggaaagggcccaaaacacaagccaacatgcacatgtaatgtctgtctgaccgtaaagcgccgtttccgcaccttgatgctgaggcgcgaaaagaaacagttggagaaagaaggggaaggttcgcgcaagaagctgcaacatcagaacctatcacttgcagaaaaatcaccggaagacgacccttcaaagtgcaataacaacaatgcaaatggcagcccaagccagaaaaaggtgggcaatgatggttccgacgacgaaatgaacagggttaaaagctcgggttcaccttttaaaggtcagatcgatcttaatattcagccagagcgcgaggaggagctctcgcctgggtcagattctggtggtatgatgaagttgctacatgatgccacccagaatatctcaggcagagggct

SEQ ID NO: 1202 - DNA, 447 bp, Eucalyptus grandis
ggaagtacgacgagatgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggttcatgggatgcggataaaaaatggcaaagctacttacgtctctcgctatgtgaggacgtcgaaacttaagcaagaggagtactatgggggagctaaatttatgaagattggagaccttaaagggc

SEQ ID NO: 1203 - DNA, 454 bp, Eucalyptus grandis; identical to SEQ ID NO: 301

SEQ ID NO: 1204 - DNA, 352 bp, Eucalyptus grandis
gttttttacgcatgtagaaaaagtcattgagtttgcctgtgctgcatacattcattgctttagctgactggggcctgagagagtttgtgtatgttactggcagacgccgaaggcggaaaggagaagaaggaagttaaagaaaggttcgccttcaagacgaaatccgaggttgagatactagatgacggattcaagtggaggaagtacgggaagaagatggtgaagaacagtccgaatccgaggaactactatcggtgttcggtggaaggctgtcctgtgaagaagagagtcgaacgggacagagacgacccaaggtatgtaataacaacatacgagggcatccataatcacc

SEQ ID NO: 1205 - DNA, 400 bp, Eucalyptus grandis
ccgaaatggccgaacttgatgaatcttccactttggaactcatcacgcagtatctcttagaagactctatcaacctcgctcaactccaaccggtgaaaacagagaacctgtttctcgatccaggaccagactcgccagattcagatcatcccacctggcaagacctggagacaccaaatcttgagattaaagccgagcccatcaccttggaatctccagagtcggagttggggtcgccggagaagaatcaggacgaggctggctccgcggccaaggcaagttacagaggggttcggcgaagaccatggggaaaatatgctgcggagatacgggacccgacacgtaaagggagccgggtctggttagggacctacgacacggacgtagatgctgccaaggc

SEQ ID NO: 1206 - DNA, 408 bp, Eucalyptus grandis
  misc_feature (1)...(408): n = A,T,C or G
tttttctcccttggtgcgtgatgtgtggaggcgccatcatttccgacttcgtcgagngcggctcgaccgccgccgccccgggagctgccgccccgagaggaagctgacccctcacgagctctggtccgagctcgaccccgcctccgacctcctcagcctcgacggccccgtggcccaaggccaccccaaccctttctctctcgtcgcaaaccaactcaaccaagtgatgaagagtgaagagaagaacagtgaggaggcgggtcacggacacgtgtcggagacccagaagagccagagcaatggccggagccagagggctcgcaagaacgtgtacagagggatccggcagaggccgtggggcaagtgggccgccgagatcagggacccccacaagggcgtccgcgtctg

SEQ ID NO: 1207 - DNA, 270 bp, Eucalyptus grandis
accgtgggatccggcagcgcccgtggggcaagtgggcggcggagatccgcgacccgaggaagggcgtccgggtctggctcgggacgttcaacaccgccgaggaggccgcgcgggcttacgaccgggaggcccgtaagatccgcggcaagaaggccaaggtgaatttccccaacgaggacgacgccttctccaccatcccgcgggctcaccagacccagcaccaccacccccaggtccccgaactaccctcctctgtatcaacccaactgg

SEQ ID NO: 1208 - DNA, 339 bp, Eucalyptus grandis
ctttctgctggacggaaaccactttggggcagctcgatccccgtgatgcgcaactttggggggccaccaggtctccttgcgaggcaatgaatgagggcgggccattgaaaaccataaaggataccaaaatcgataatatgcagtttcgtcgctttctcagatatgcttaaaatcatatggttagaatagatgatcgcaaacctctgaaatgggaaaactgagagataagctcggtaagctttcaacatttcagtagcagatttccttttggagcctaactccgtatagacttgcgctcctgtgcaatccatgcgtgccttaagggcttcggcaaaagag

SEQ ID NO: 1209 - DNA, 405 bp, Eucalyptus grandis
aaaccctgcaattcaggaaaagaaacccctttttgatctctctccatctgctccgatggtcggttcggaggggatgaattcttgaaaaacaaggaggaacgatcgtctcctttcttgggggggctggggattggggggaggaatgggggcgcagcacaactcaggacgaacccggaatgggagacccatgtgatcctgaacgtgtacgatctcacccccgcgaacagctacaccgcctggtgcggcctgggcatcttccattccggcattcaaggttctctgtgtagttgcattcttccagaaagccttcaagtaactactgttaagccagagtatcatgacttctccgaggaagatggtgctgaatctgtgtcgactgtgactaccgagatagatgacgccgag

SEQ ID NO: 1210 - DNA, 521 bp, Eucalyptus grandis; identical to SEQ ID NO: 238

SEQ ID NO: 1211 - DNA, 537 bp, Eucalyptus grandis
ttcgaaaatcccatttcctctcgacctgtgtagcttgcaactcttggagtcttgatagagaaggagagagaaggagaaagagtgggtgatgggtttcgggggaagttggagcgtgcccgcgaaggcgtgcgactcgtgcaagaccgcggcggcggccgtgttctgccgcgccgacgcggcgttcctgtgcctcggctgcgacgcccgggtccacggggccgccaagctgtccgcgcgccacgagcgggtgtgggtgtgcgaggtctgcgagcaggcccccgccgccgtcacctgcaaggcggacgccgcggcgctctgcgtcacctgcgacgccgacatccactccgccaaccccctcgcccgccgccacgagcgggtgcccgtggagcccttcctcgacgccgccgagtccatctccagggccgcctccgccttcaacttcctcgccgtgcctaccaagaccggcagcgccgacacgtgcggcggcggcggtggcggcttcggcggctcgtgccagaatgaggagctggaggaagc

SEQ ID NO: 1212 - DNA, 399 bp, Eucalyptus grandis
ccgaaacgcctttttcctcacatttcccatctccttttccaagaagcgaagcccgaaaagtccaatccccgttcttccaaaccctgcaattcaggaaaagaaacccctttttgatctctctccatctgctccgatggtcggttcggaggggatgaattcttgaaaaacaaggaggaacgatcgtctcctttcttgggggggctggggattggggggaggaatgggggcgcagcacaactccaggacgaacccggaatgggagacccatgtgatcctgaacgtgtacgatctcacccccgcgaacagctacaccgcctggtgcggcctgggcatcttccattccggcattcaagtgcatggtaaaggaatatggctttggagcgcacgacttttccagct

SEQ ID NO: 1213 - DNA, 283 bp, Eucalyptus grandis; identical to SEQ ID NO: 270

SEQ ID NO: 1214 - DNA, 324 bp, Eucalyptus grandis
ttttcaagaagcacgcccacgtaacgggggaaatgctgagggagaacccatctgacggttctttttgttgagggaagggaaagagagaggaggcagagggaggaaggaatccgcagcagcagtcgtcggaggaggaggacattttccaggtgaaccccaagtagaattgcgatattggtttattcgtaatgggctgcgtcgcttcaagaattgatgaagaagagagggttcgggcgtgcaaggagagaaagaggctgatgaagcagttgctggtgtttagggaagaatttgctgatgccctgttggcttacttaagagccctga

SEQ ID NO: 1215 - DNA, 358 bp, Eucalyptus grandis
tttaatggccttgacgcaggggaggggagattttctgaacttggggagatggtagaatagctgccgaggtgtcaactcatgtcagaattctgactgatctggggatcttgctctcaaagaggatttctaagagcagtatctcaacttggcatacgttcagcaactggaaaatagtaggttcaggcttatgcaactggaacaggagcttcaacgagcacgccagcagggtatatttgttagttctggaaatcctggggatctcagtcataacatggctgccattggcaatggggccatggcctttgacaccgactatgcccggtggctcgatgagcatcaacggctgatcaatgaccta

SEQ ID NO: 1216 - DNA, 329 bp, Eucalyptus grandis
ccgctgtggcaagagctgccgcctccggtggatcaattacctgcggccggacctcaagcggggcaacttcaccgaagaagaggatgagatcatcatcaaactgcacagccttcttggtaacaaatggtcgctcattgctgggcgtttgccggggagaacggacaacgagatcaagaactactggaacacgcacataaggaggaagcttttgaaccgaggcatcgatccggccactcacaggctgatcaatgagcccgcacaagatcaccatgacgagcccaccatttcttttgctgctaattctaaggagatcaaagagatgaagaaca

SEQ ID NO: 1217 - DNA, 346 bp, Eucalyptus grandis
aagaacgtcgccccatcaactccacccggcgttttcaagaactcgcagagatcaagaactcgagccggcttctgcagcgtgcaccgttatgccgtcggagtgcgccgaccgcaagcccgcgaaggccccccacggcggccacctccacgcggccggggcgggggccgccgcgccgcagccgcaggagcaggagcacctcccctgcccgcgctgcgactccaccaacaccaagttctgctactacaacaactacaacttctcccagccccgccacttctgcaagtcctgccgccgctactggacccacggcggcaccctcagggacatccccgtcggcggcggcagc

SEQ ID NO: 1218 - DNA, 468 bp, Eucalyptus grandis
aaactgggatagatggcgggcagacgatgaaaacgttgatagggagcttaatgataatctaaatgcaccttcataccctcctcaccaacctacgcaatcttatccaagaggaggctatagagtatgtagtggctgcaaccgtcaaataggctatggcaactatttgggatgtatgggaactttcttccatccggaatgctttctctgtcgtgcttgcaggtaccccattcaagaatatgagttttccttagcaggaaaggatccttatcaccagtcttgcttcaaggagttgacacatccaaaatgtgaagtttgccatcaatttatcccaacaaatggagttggtttgattgagtatagatgccatcctttctggtcccagaaagtactgtccgtcgcatgagcttgacaaacacagctccgatggttgtagttgccaacggtttggaggcatgggaacaccaccat

SEQ ID NO: 1219 - DNA, 162 bp, Eucalyptus grandis
tgaggtagatattcttgacgatggttatcgctggcgcaagtatgggcagaaagttgtgaagggaaacccgaacccaaggagttactacaagtgcacaagtcctggctgcacggttaggaagcacgtagagagggcgtcacatgaccttaagtcagtaattac

SEQ ID NO: 1220 - DNA, 354 bp, Eucalyptus grandis
gcctggcatcacttctgaaagaagatgatgggtacctgaatattctttgtccatgatgaaagcacagggaagtcggcagtaaatgtaattgatgcgaaaaacatgtcatctgatcctgttgctgttgttgaattaccccatagggttccttatggcttccatgccttcttcgtgactgaggaacaacttcaggaactggctaagctgtaggtctctacatgcacgaattgttgggaatgcagatgttgcgaggggaggcatatctctggaaagctgctacagttgatctaatagtttgatatttacatggacagacatctttatgctaaatatagtggaaatataaagtatggt

SEQ ID NO: 1221 - DNA, 310 bp, Eucalyptus grandis
gcggaggaggggctgagtcggaaattggggaactcggttgcttgcgaaggtagggaccgggtcgaaagatgcgaggtgttcgggaagtggagggcccgcatggggatggctgggttcgagctgaagccactgggtcaacacgtggccgaatcaatgaaggcgaggctcgaaagtgggaaccgggtcaacccgggattcacggtgaaagaagagaatggtgggatttgcttcggctggctcggccgaacactcaccgtcgcatccgcctggcgttaagctccactcgctccccctctctcccccctgtgca

SEQ ID NO: 1222 - DNA, 315 bp, Eucalyptus grandis
  misc_feature (1)...(315): n = A,T,C or G
atttcagatcccatcatgnatgcatgactttgccattacagagaattatgcaattttcatggatcttcctctttatttcaggcccaaggaaatggttanagataacaagctaatatttacatttgataaaaccaaaaaatctcgctttggggtacttccacgatatgcaaagaacgagcttcaaatcagatggtttgagcttccaaactgcttcatttttcacaatgccaatgcatgggaggaggaagatgaagttgttttggttacatgccgtcttgagaatcttgatctggacatggtcagtgggactgtcaa

SEQ ID NO: 1223 - DNA, 393 bp, Eucalyptus grandis
gcttaatcctcaaagaaagtgaagctacccttcgtgaagctcttcggaacatgatgcagaatggcaaatcgaaagtgccaaatgaggggaaggcccacggcaagaagcaaggcaggcgcaagagggatgtggtcgacttgagaactcttttgacactttgtgcacaagctgttactatggatgatcgaggaagcgcaggtgagctgctcaagcagatcagaaggcatgcgtctcccacaggggacgggatgcaaaggatggcacactattttgcgaatggtctgcaggcacgccttgccgggtcaggctctcaaatttttaaggctctcatggctaggccaagatcggctgttgatgtcttgaagggttatcatctcctcctcacaattttgt

SEQ ID NO: 1224 - DNA, 337 bp, Eucalyptus grandis
  misc_feature (1)...(337): n = A,T,C or G
gagaaatcctcatcatccgtcaaggcaatctcggatcctcaagccagccactgnagaagtgttcgtagcatctcttctcaaagatctagccgagatccccggccttcttcaagcagcttacgatctttacaagtgggaccttcagaagagagactgccatcagtcgcagatggttactcaagacattcgaggccactttctgccataggatggcgtaataatgatggggctcggagatcaagggtatctactgaaagatttcggtcgtttcctgatgaaggaagtggccgtgatcaattagaatatgagggattcatgattgcggatcgcccaggtt

SEQ ID NO: 1225 - DNA, 226 bp, Eucalyptus grandis
  misc_feature (1)...(226): n = A,T,C or G
tgttggcaccatgtacacacacagtgtggtaaagcaggctttgggatgctcaagcaagagaatctgagcaatgaactagatagggtcaaaaaggagaacgacaacttgcagattcagctcaggcacctgagagngaagacataacatcactgaaccacagagagctgataatcctagaagacactcttgaaaacggcctcggatgtgtccgagaccagaaggacga

SEQ ID NO: 1226 - DNA, 415 bp, Eucalyptus grandis
cggaccgccaggactgcacggtggcgtgccggatgttcgggccggggtgcttcgggggcgagcccttcttcgtggcgagggatccggacgattcggaggcggaggaggacgacggctacgtggtgagttacgtgcacgacgagcgcaaaggggagtcgaggttcctggtgatggatgccaagtcgccggagctggacatcgtggcctccgtccggctacccaggcgggtgccgtacgggttccacgggctattcgtgagggatagccacctcaaaatgtcttagcgttcatgggcgatgatgcgacgtggaggtacagagattggggtcttttattacaggattttacgtagtctagagcatgatacaaagctatatcccaccaacatgccgcagttaaattaggtggggtagtt

SEQ ID NO: 1227 - DNA, 389 bp, Eucalyptus grandis
  misc_feature (1)...(389): n = A,T,C or G
acattcatggggatatgcagcctccaacattcatctcagcaggcggaggaggcgctgtcccaggggctagaacagctccaacagtcactcgtcgacaccattgccggcgggcccagcatcgaaggaatgcaacagatggcaatcgccttgggcaaattaaccaatctcgaaggctttgttcgacaagctgataacttgnggcaacatacccttcatcactgncgccggatactgagagttcgacaagccgcacgcgattttttggtgatcggagagtattatggtcgactacgagcattgagtactctatgggcgtctcgtcctcgagggtgcatgatggatgatgataactcacgccaaacaacaacggacctgcaaattgttcaggt

SEQ ID NO: 1228 - DNA, 435 bp, Eucalyptus grandis
cttcaccggcactaggaatcagggcttcttggagggatttgggttctccacctcgtcgtccacgttgtcggaaactgcgaaccggggggagaactccgggagtgccggggtgttcagattgaactcgcggtgcccctgactttgcgtgagttgacgccacgccctccgagacgctcaccctgttggcagtcaaggcgacggcgacgcgacggcggctgaggagacaggagttggggcctcatagtggtacctcgtgcccaccgagagcttggccggtaggggagctcttgtggcagatcgagcactcgtggaccttcccggacataccggaggaggtggtcgtcgcggaggtcgaggtggccggctgttcgtccgcaccggcgaagagaaagtgtgttggtatagaggcgagaggagagagaagagagagaagaa

SEQ ID NO: 1229 - DNA, 252 bp, Eucalyptus grandis
gcaatccagacccagatgcggaagtgatagccttgtcgccgaagacgctcatggcgaccaaccgattcatatgcgagatctgcaacaaagggtttcaaagggaccagaacctccagctccacaggagagggcacaacctgccttggaagctgaagcaaagaccaaaggatgaaccgataaggaagaaggtgtacgtttgccccgagccgacatgcgtgcaccatgacgcgttgagagcgctcggtgatctca

SEQ ID NO: 1230 - DNA, 326 bp, Eucalyptus grandis
  misc_feature (1)...(326): n = A,T,C or G
catccatgcccgagaccggaaacgccgcaacggccgcagctccgatccccatgccggggaatttcccataccgcgcccaggagatccagtagggggggcgtccgnaagcggccctggagggggtatgcggccgagatccgagacccggagaagaagacccgantctggctcggcaccttcgacaccgccgaggaagcagcccgcgcctacgacgcggccgcccgagaattccgcggctccaatgccaagactaacttccccctcggnttccgcgccccccaggtcatggccaagaccaactcggtagatgcatcagcgagtagcgg

SEQ ID NO: 1231 - DNA, 424 bp, Eucalyptus grandis
cttcctacctcgtcagcccttcggctgttggatcaggttccgaaactgtgttcctagacttgagccttggttgcagcaatgatgagtccagcgggagggattctgtaggagtcgccttctcgagcaccagcgaatgtagcaatgagcccgaatctcatccggcagctgcaggaccaaccacttcaagagtcttttcttgcaattactgtcaaaggaagtttttcagctcacaggcactcggtggccatcagaacgcgcacaagagagagaggaccctggcaaagcgggcaatgaggatgggcatgttttcttcacagagatattccagcttggcgtctttgcctttgcacgggtctcccactgtcagggatctggggatcaaagcgcattcttccgtgcaccaggtgcaccaaggcatgttgca

SEQ ID NO: 1232 - DNA, 321 bp, Eucalyptus grandis
atgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggttcatgggatgcgg

SEQ ID NO: 1233 - DNA, 508 bp, Eucalyptus grandis
  misc_feature (1)...(508): n = A,T,C or G
gacgagatgatnatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggttcatgggatgcggataaaaaatggcaaagctacttacgtctctcgctatgtgaggacgtcgaaacttaagcaagaggagtactatgggggagctaaatttatgaagattggagaccttaaagggctttttggtttactcatggtcaatatgcaaatgctgagagcaaaactgaaaatactagatgtttcatatg

SEQ ID NO: 1234 - DNA, 503 bp, Eucalyptus grandis; identical to SEQ ID NO: 305

SEQ ID NO: 1235 - DNA, 367 bp, Eucalyptus grandis
aaaaagtatatatacctcggcctatttgatagtgaagtagaggcagcaagggcgtatgacaaggcagctatcaaatgtaatggaagagaggctgtgaccaactttgaacctagtacgtacgatggagagatgattgcaaaagccagcaatgaaaatagcatctatggtgaccatggtcttgatctcaatctcgggatatcagcttcttccaggggaatggtggaaaccttagagccctcggacgacatgcgtcagggaagtagtttaagggtaggaaactctgctgcatcctggggtgatccatctgttgaaggtttatcgatgacatctggacaacctcctccttgacgggtgtttatcctagcgt

SEQ ID NO: 1236 - DNA, 360 bp, Eucalyptus grandis
ctccgccgtggcggtcgccgcgacaacagcaacaacctcctcctcctccacctcctcgaccgggtcggatccggcgctagaaccgagcaaaagaagcgaggattgcacttctcaaaagggcccggggaagtccccgagcccgggcgcccacccggaggagccggccggcaagaggcacaaggccgggggctccggcgagcacccgacgtaccgtggggtccgaatgcggaactggggcaagtgggtgtccgagatccgggagccgaggaagaagtcgagaatctggctcgggacgtaccccacggcggagatggccgcccgggcccacgacgtggcggcattggccataaagggcagctc

SEQ ID NO: 1237 - DNA, 539 bp, Eucalyptus grandis
  misc_feature (1)...(539): n = A,T,C or G
tctctctttctctctcctctgtgattgcagatcaggctcccacgccgttccattcgcgcatctccgacctcctctctccacgcggccactgtcccgtcgcgcgaattcaccccgccgtcgtaggagaccgcatcctacgccgccgnggcgnanggcggcgccacgaggagatgccaggggaaggaatcaattacttcctcgttactggcccaggataacagatcaagagctacaacaaatctctggagagtatccttttgttctatgtgctttgattgatttatagcaactcctagaaaggtgaattatcgcgcgtcaatagaacagggttaggatttcaatagataggatgaaaagccgggaaggttcagtttcacctctgctactaattagcattcatgatcctattccttaacttttataagctcaaactctgtaatcactcctctgtttgagaaaatgttgagtgctagtgatgcaggtaaaattggacgtttagtgctgccaagaaaatgtgccgaggcctattttccggctat

SEQ ID NO: 1238 - DNA, 520 bp, Eucalyptus grandis
tctggctgtcctgatagctttgatgaaggcagatctggaatttttgaattcaaacctctagctacatcaaacttggtccccacagaggcaaagcaccaaggaagtgaacaggctgtgaaagtttcaggtcaacgtcattctcaaccatttgcatcactgtcttcagttcagagtgatttggctgtctcatcgaaggaattgtgtctatcggtacccactcaagcggttcgctcaggggctagtccacttgctgaagctgatcctgatggattgttaggtaggaaagagcagcccaataatgtgatgcaggtgacacaactggataataaagggaatggcccttcagtcatgactgagagactctctgacgatggatataactggagaaaatatggacagaagcatgttaagggctgtgaatttccacgcagctattacaaatgtacctatcctaattgtgaggtgaaaaagcttttcgaacgtgctcctgatggacatattacagagattatctacaaag

SEQ ID NO: 1239 - DNA, 489 bp, Eucalyptus grandis
ctcagatgtgggacaagctgagggagattaaaaattcattgcttggacctgaatctgatatcagtgatagctgcaattgttgcttaaatagtgggagccaccaattcacgtcaactgggcagtgggatgtacgtcagatgatagagatgatccctaaaattggatttgaaggacatgctgattttctgtgcacaagcagttgccgaagctgacatgcctaagacagctgctttgatggaggtgttagagaggatggtgtctgtctcaggagatccaatccaacggttgggtgcttacttattagaagggcttagagcgaggttggaatcatctgggagcataatctacagaaagctcaagtgcaaagagcccactggctcggaattgatgtcttacatgtccatcctctatcagatttgtccatactggaagtttgcctacgagtcggcaaatgttgtaattggggaagctataaagtacgagtcaaga

SEQ ID NO: 1240 - DNA, 306 bp, Eucalyptus grandis
  misc_feature (1)...(306): n = A,T,C or G
gccaacgctcaccnccttggcagctgaggcagcggcggcggccgaggaggcagcagtgagggcctcgtagtggcaccgcttgtgcccgccgagagcgtggccggtggggaagctcttgtggcagatcgccggaggaggtggttgccgcggaggtctaggtggccggttgttcgtccgcgccggcgaagagaaagtgtgctggggagagagagagcgtgcagagaggtagaagagagagaagagagaggagagagaacgtgaaaggaggcagaagagagagagtgcagcgaggggagagagaggaca

SEQ ID NO: 1241 - DNA, 366 bp, Eucalyptus grandis
gagcattttcttcatccttacccaaaggattctgacaaaatcctgcttgcaaggcagacaggcttgacaagaagtcaggtctcgaattggttcatcaatgcaagagtgcgtctctggaaacctatggtcgaagaaatgtacaaagaagagattggggatgcggaaatggactccaactcatcctccgacacagccaagccaaaaacaggagatatcaagtcctccatggaggaccgggtggaagaagtgcaacagagttcaacagctacacagagatgcagctcaggccagctcatggactcatcattcgaccggactccagatgtcgaaatggcaggccactctgtgggattcaactacctgaac

SEQ ID NO: 1242 - DNA, 340 bp, Eucalyptus grandis
cttcggcctcgtcgaccaccggaatggcatgggcgtcgcgaacgccggcctcgtgtacttcgacggccacctcctcgcgatgtccgaggacgacctcccctaccacgtgcgcgtcacgcgctccggcgacctcgagaccgtcggccgctacgacttcgccggccagctcgactctccgatgatcgcccacccgaagatcgacccggcttccggcgagatgttcgccctcgtcaagtacttccgattctccaaggacggcgagaagtcccccgacgtcgagatccccctggctgagccgaccatgatgcacgatttcgcataccgaacgctttgtcgtgat

SEQ ID NO: 1243 - DNA, 684 bp, Eucalyptus grandis
ctctctctccctctcccccctaacgtttctggccctcttctttgtctggacaaaaagatgggaagaaagtgctctcgctgtgggaacataggccataactcaaggacttgcacaactttcatgggggcagcaagttcttgtgggctcaagctcttcggtgttcaacttgacctatcttcttcttctcctccttcatcatcagcatctagtggttctgctcatccttattcacttgtcataaagaagagcctcagcatggatcgtctgtcttcttcctcggcctcctcctcgtctccatcttcatccctctcctcgccaagagttcttgctgatgaacactgcaataagacctccctcggatatctctctgatggcctcgccgccagatcccaggagaaaaggaaaggagttccatggacggaagaagagcatcggacattcttaatggggctagagaagatggggaaaggcgattggagaggcatctccaggaactatgtgaccacgagaaccccaacccaagtcgcgagtcatgcgcaaaaattctttctccggcaggccagtcttaataagaagaagcggcggtccagcctcttcgacatgggtagttttcggtaaccatgtcacaaatccatacattaattgggcaccaaactcaccgaaagaaaactcagagtcttttca

SEQ ID NO: 1244 - DNA, 329 bp, Eucalyptus grandis
cggccccgcagcttggtcggcgtacctcagaaatggctcaaatggtttgtggttcctgccaaagattgatttcatatcagccaggagccaaatatgtgcaatgcttatgctgcaagacgattaactttgtgttggaagagcatctggttggacaagttaagtgtggtacatgtgcgatgttgcttatgtacccgtatggcgctccagcagtcaagtgttcggcctgccgttctgtgacagaaattggggagcacaacaaaaggaccccatgggcggtacagcaagggagacttccccctcccagtacagttccttgatgggcacacgca

SEQ ID NO: 1245 - DNA, 383 bp, Eucalyptus grandis; identical to SEQ ID NO: 279

SEQ ID NO: 1246 - DNA, 380 bp, Eucalyptus grandis; identical to SEQ ID NO: 111

SEQ ID NO: 1247 - DNA, 360 bp, Eucalyptus grandis
gcagccgagtcgagcaagaaactaacgaacgcccggtgtcattaggattcataatccacaagaacaaaagaaaaaaggatcatgggaagatccccatgttgcgaaggcaatggcctgaagaaagggccctggtcttctgaggaagacaagaagctccttgattttatccagcagcacggccatgggagctggatctctctccctaaacgtgcaggtcttaatagatgtggcaagagctgcagattgagatggataaactacttgtggccggacatcaagagagggagtttctccccggaagaagaacaaaccatcttgcatctccactccgtgctcggaaacaaatggtcggcgatcgca

SEQ ID NO: 1248 - DNA, 351 bp, Eucalyptus grandis
tttttttttttttttttttgaaagtaaacgaatttaagattaaattaaatatggggaacccagctagctagtcaagtttgaaaatgttgtgccaatttctgtttctttaatacaaagttggggaaaacaaaatttacatccgctcaaatttgaggtaaaaaaaaaccctatctcctccggctttgacttgtcagccgccctcaggttgacttgaataccaggttcatcgcaccggcgggcacaatctcctgcgacgcgggctgggagtgacgatgctccccctcgtacgtcacgatcagcatcgttggatcgtcgggggccctctccacgtgtttcctcgcggggcaccct

SEQ ID NO: 1249 - DNA, 419 bp, Eucalyptus grandis
gacgagatgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggttcatgggatgcggataaaaaatggcaaagctacttacgtctctcgctatgtgaggacgtcgaaacttaagcaagaggagtactatgggggagctaaatttatgaa

SEQ ID NO: 1250 - DNA, 632 bp, Eucalyptus grandis
ccccccgcgacgaccggacggccagtccagattccctcgccgtcgccgccgtgaaacgccggagcgcacggcgcacggacccgacggacgccgtcctccgccaccgtcgccgaggttgagagccatgtcgagcgacgcgcgcgccgcctccggcgccaccgccgccggcgccggggagttcatgctgttcggggtcagggtggtggtggtggaccccatgaggaagagcgtgagcctgaacaacctgtcggagtacgagcagccccaggacgcggcccccggcggcggcggcgtcggcaaggacgacgcgggagcggccgcctccggctacgcgtccgccgacgaagccgtcgcgcacggctcgaaaggcgggccggccgcgagcgcaagcgaggagtcccgtggacggaggatgaacaccggctgttcctgctcgggctacagaaagtaggaaagggcgattggagaggcatttcgaagaactttgtgaagactcggacgccgacccaggtcgcgagtcatgcccaaaaatactttctccgccggagcaaccttaatcggccgtccgccgccggacttagccttgtttgacatcaccacccgatacggtcactggttggtacaatgatgga

SEQ ID NO: 1251 - DNA, 202 bp, Eucalyptus grandis
atgcgaaacatgctcaaacacccccaacatcatgggaaggtggaagtggggctgattcggaggttaacatgttgaaggattacgcttcagaggactggattacaggtgttgaccgcttccggttgagcttggttgaatttcttgataagttgaataagtatgcggagtcctctgttcatatgtacgtgtcccttgaaaaggc

SEQ ID NO: 1252 - DNA, 378 bp, Eucalyptus grandis
gagataaagaactactggaatacaagaattaagcgactgcaacgcactggcatgcctatatatccaactgaggtttgtctgcaagtgtcaagtgagaatcaagaaactcataacatgggtaacttgcatactgcaggcgaagataattgtgatctctcacaggcagatccactcgagatcccagaggtggattttagaaaactggaactgcatcttggtttctcgtctttttggtctacacttctggacgttcctccttgtggctttgggagagaggcaatgtgtctatctgatgcttactgccttccatttccatcaagccggtctcctaaacgccttcggggttctgagaccccatttcctgtcttggatgctgga

SEQ ID NO: 1253 - DNA, 388 bp, Eucalyptus grandis
gtgattttagtgctcgatactttgaaaagggcatcaatacagtcaaacgagataaaaagacataacatgcaaaactcaatacatgattctcagaaaagaccatcatctttaattcagtcaaacgaggctgtttttacgcaaacttcggtcataagctgtgccttgcaatcgtttgttaaacctccaaatgctaaggtcacggtcacattcctctctgatctttgagcagctcatggcaccaacgtccaaggaacatttcttaaaaaggatgatccaaaagttactgctctgattcaacaagccgagctgctcagttcccttgcggtgaaagtcaatgcagataacatggaccagagtcttgaaaatgcttggaagggtctccaggaat

SEQ ID NO: 1254 - DNA, 380 bp, Eucalyptus grandis
cgacgatcgggtcgggtcggttcgggcgtcgccatgacgcggcggtgctcccactgcagccacaacggccacaactcccggacctgccccgcccgcggcggcggcggcggcggcgggggaggcggcgtgaggctcttctgggtgaggctgacggacggctcgatcatcaagaagagcgccagcaccagcagcctctcgtcccaccacctcctccccccctcctcctcgccgtcgccttcgccttcgccgtcgccgtcgccggccgcgggctcgccgccgtcgggcgaccaccactacgaccaccaccaccaccagcagcgcgacccggacgggtacttgtccgacgatcccgcgcaaggggcctgcgcgtccgatcgccg

SEQ ID NO: 1255 - DNA, 350 bp, Eucalyptus grandis; identical to SEQ ID NO: 113

SEQ ID NO: 1256 - DNA, 377 bp, Eucalyptus grandis
tctcaatgggattagcggaaagaagaaccaccagagggaggattcagaatttgaagatgagaggagtaacaagcagacagcagtgtatgttgatgacaccgagctatccgagatgatggataaattgttggtctgtcatattaaaggcaagagtcgagattcaaatgctgatgaatcctctaaaaaagaagtaagtaaatctttacagcagaatagacagacacacactgctgatggtgggaagtttcataataagaaaccaaccccaaccagcaatatgacagagatggtggatctcagaactttgttgatcctttgtgcacaagctgtctcttctgacgatcgaaggactgctaatgactatctaaggcagattc

SEQ ID NO: 1257 - DNA, 651 bp, Eucalyptus grandis
actcgtggcgctgtttcgagctttctagcttccggaggaggagggctggtgttgagcgaaacttggagaggtcatgaattcgacaaccactcagtttgtgtcctctagaaggatggggatgtatgacccgattcaccaaattggaatgtgggacgagaacttcaagcagaatggaaatcctaatgcgccgccagctctgatcatacctatgcacgcgaatttggacaaccagtcggaggatacttctcatggatcacaggatactgctggcaagtatgagcaagaaacatcgaaaccttatgataaggtgcaaagacgtcttgcccaaaaccgtgaggctgcgcgcaaaagccgtctgcggaaaaaggcttatgttcagcagctagaagcaagtcgtttgaagcttatgcagttagaacaagaggttgaccgagctaggcaacagggtgtgtacatggcttcaggagtagattcagcttatccaggatatggtggatgtttaaattcaggaatcgttgcatttgagatggagtacgggcactggattgatgaacagaatagacaaatatgtgagctgagggctgctttgaatgatcatagaactgacgtagagcttcgcatcctcgtggaaagtggcatgaaccactattc

SEQ ID NO: 1258 - DNA, 311 bp, Eucalyptus grandis
gacgagatgatgatgaagaaggggagcgacggagggatagcggaggtgaatcccacgccgagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatg

SEQ ID NO: 1259 - DNA, 588 bp, Eucalyptus grandis; identical to SEQ ID NO: 325

SEQ ID NO: 1260 - DNA, 620 bp, Eucalyptus grandis
tgaaaatcgtattgtcctctttcgtcttgatgcgttgaagaactaaaagaaggagccacaaacactgaggaataaaccttagaactaccaaataaggagagcccacgggactcgttttcttgtatgccacaacggtccgaaccttcttttggtgaggccggggagcaaactatcgtttcttcgacgagggtattgacatccttcgaaccacctgcactcctcctgttccgatccggccatggatgattgagaaaagagttgagaactgatgacgatgacgatcttgcttgttgctgcttcatatttgcatgctggagaatctggtcgactttcggatgctgccctacgaagctgcagttcacctcggggtgattaccgatcagctggtggcacgggaagttcgtcttcgcgttcctccctcggagaagccaggccgcgctgtcgtaagccaaggcggcttcctcggcgctattgaaagtgcccagccacagcctcagcttcagcgtggagtccttgatctcggcgacccatcttcccgaaggcctttgtctcaccccgagaaaccttctcattgcatcatcacccttcgctcttctcttgatgttcttcctcatggctat

SEQ ID NO: 1261 - DNA, 562 bp, Eucalyptus grandis
gataaatcgtcttcaccagtacctccgcaggatcagacgggtgttcatgtttatcatcctgattgggctgctatgcatgcatactatggtccaagagttgctcttccgccttattataattctgctgtatcatctggtcatggtcctcatccctacatgtgggggccaccacagcctatgatgccaccatatgggccaccttatgctgcaatatactcacatggaggtgtttatggacatcctgcaattcctcttactccgactcccttggctgcggaaactcctaaaaagtcatctgctaattctgataatggactggtgaagaagttgaaaagttttgaagggcttgcaatgtcaataggcagtgggggggatgcagacagtgctgacgatgggactgataaaaggtcatcacagagtgcagactcgggagactcaagtgatgaggatcaatcaggggcagataaagccaggaggaaaagaagccgtgaaggaacttcatccaatggcgatggaaaatctgaagtgcaaggaaaggctgctggggaggtggatgctgttt

SEQ ID NO: 1262 - DNA, 384 bp, Eucalyptus grandis
gacgagatgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggttcatgggatgcggataaaaaatggcaaagctacttacgtctctcctatgtgaggacgtcgaaacttaagc

SEQ ID NO: 1263 - DNA, 381 bp, Eucalyptus grandis
ccgcgccactccattcgcgcatctccgacctcctctctccacgcggccactgtcccgtcgcgcgaattcgccccgccgtcgtaggagaccgcatcctccgccgccgcggcgatggccccagcttcattccctgcgctagcaacgcatttcaatggaagtatgctaatgatactaactcatctggtgaaagtcacacacgtaatggaaggccacgaggagatgccaggggaaggaatcaattacttcctcgttactggcccaggataacagatcaagagctacaacaaatctcaggagactcgaactctgtaatcactcctctgtttgagaaaatgttgagtgctagtgatgcaggtaaaattggacgtttagtgctgccaa

SEQ ID NO: 1264 - DNA, 316 bp, Eucalyptus grandis
ccgagaagaggacccccaagaagagagggaggaagccaggcctcggccgcgacacgccgctgaaccacgtggaagccgaacggcagcgccgggagaagctgaaccaccgcttctatgcgctgcgagcggtggtcccgaacgtgtccaggatggacaaggcgtccctgctctccgacgcggtgtcctacatcaacgagctcaagtccaagatcggcgatctggagtcccagttgcagagagagtccaagagggtcaaacaggaggtcaccgacgcaaccgacaacctgagcaccaccacctccgtcgaccatagtag

SEQ ID NO: 1265 - DNA, 356 bp, Eucalyptus grandis
tcaggctcccacgccgttccattcgcgcatctccgacctcctctctccacgcggccactgtcccgtcgcgcgaattcaccccgccgtcgtaggagaccgcatcctacgccgccgcggcgatggcggcgccacgaggagatgccaggggaaggaatcaattacttcctcgttactggcccaggataacagatcaagagctacaacaaatcttggagactcaaactctgtaatcactcctctgtttgagaaaatgttgagtgctagtgatgcaggtaaaattggacgtttagtgctgccaagaaaatgtgccgaggcctattttccgcctatttcccagcctgaaggattgccgctca

SEQ ID NO: 1266 - DNA, 360 bp, Eucalyptus grandis
gcgcgcacgagacatgggacgatccccttgctgcgagaaggcgcacaccaacaagggcgcgtggaccaaggaagaggaccagcgcctcatcgactacatccgcctccacggcgaaggttgctggcgctccctccccaaatctgccgggcttctcaggtgcggcaagagctgcaggctcaggtggataaactacctccgccccgacctcaacgcggcaacttcaccgaggaagaagacgagctcatcatcaagctccacagcttgctcggcaacaagtggtctctgatcgcggggagattgcccggaagaaccgacaacgagatcaagaactactggaacacccacatcaagcgcaaagct

SEQ ID NO: 1267 - DNA, 375 bp, Eucalyptus grandis
cgcccacccctcctcgcagcccagcgctgccgctcacttcagtcaaggggtaccctgcccgcaacagcatttccgagtatgacccgcgaaggcgtaactcaattcccgcagaatactttactatgggctttactccctctgctcccatttaccctcccatctctccactgcacccgtccacacaactccctgctgtgacgcaggctcggccctcgggtgagtccaaaggggacccaagaaagaagtaccaatgtgccgcctgcccgcgtgcatttgccagggcttacaatttaaagacccacatggcaacgcatgaccccaacaggctgaagccccatgtctgcccccatcgttcttgcggccgttccttcagca

SEQ ID NO: 1268 - DNA, 567 bp, Eucalyptus grandis
gacgagatgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccggtcgccggataccactggtttgatggagatggcatggttcatgggatgcggataaaaaatggcaaagctacttacgtctctcgctatgtgaggacgtcgaaacttaagcaagaggagtactatgggggagctaaatttatgaagattggagaccttaaagggctttttggtttactcatggtcaatatgcaaatgctgagagcaaaactgaaaatactagatgtttcatatggaacagggacaggcaatactgcactcgtatatcaccatggaaaactgttggcgctttca

SEQ ID NO: 1269 - DNA, 567 bp, Eucalyptus grandis
tcgccacctaatgcatgcactgaatctgcagttgccaccattagacccaaaacggtgaggtttaagccagtgccaaatcgagctccaactgcagtgaattcatcccaggcagaagtctctggaacagcaaccggcaattccaatgataaggctttaaagtcagatgaaaagcctaccgtaatatacaaaccattggcaaagcttgtctcaaggtcaaccgtctcgctcttggctaatatgggaagcttcaatatggctcaccatcaaacattgtcagttgccgaagcacgtgttaaatctcaactgcaggacaaaaacaattcgagatcccagcctattggaaatctccatcggagtgtctcttcacaagcagatatggatgggacaagtgaacccttgagattggcctcccagaacatggaagaagacacgagaacttcaccggccttgaacatggatcgcccttcttacgatggatataattggagaaaatatgggcaaaagcaagtcaagggaagcgaatatcctagaagttactataaatgcacacacccaaactgcccggtg

SEQ ID NO: 1270 - DNA, 325 bp, Eucalyptus grandis
gcggggtgtacgtccggaacggcgccaacccgctccacgagccggtcgccgggcaccacttgttcgacggcgacggcatgatccacgccgtccggttctccggcggctcagtgagctacgcctgccggttcaccgagacgcaacgcctgatccaggaacggggcctcggccgccccgtcttccccaaggccatcggcgagctccacggccactccggcatcgcgcggctcatgctcttctacgcccgcggcctcttcggcctcgtcgaccaccgtaatggcatgggcgtcgcgaacgcgggcctcgtgtacttcgacggccacct

SEQ ID NO: 1271 - DNA, 365 bp, Eucalyptus grandis
cacaggcgcgatcgggccaagcgagcgtcccccccgggaattcagaacccagccgccgcgccccgccgccggcagccgccgtctccggcgcccctctccggcacctccgacgccgcccgcgtccggagcaccctcgacccttcgattcggaggctggttcgctgaggctcgaggcgacgcgaattgttatcgatagctatgcagagtcaacttgtctgtaatggctgtcgaagcattcttctttatccaagaggggctacaaatgtttgctgtgcattatgtaacacaataacctctgttccttctcctgcatatgtaggtgcagatatggcccagcttatatgtggaggttgcaggacactgct

SEQ ID NO: 1272 - DNA, 365 bp, Eucalyptus grandis
accgtgcccgcgatgcaacagcatggataccaagttctgttactacaacaactacaacctgaatcagcccaggcacctctgcagaaagtgccaacggtactggactgccggaggaacgatgaggaacatccctgttggcgctggccgtcgtaagagcaagaattcgtatgcagccacggtggcactgtttcacaacacgggagtacctgaatctcttcgagctgattgtgctggtgatttgaaaaccgccggaaccaccatcctgaggttcggttcagattctcctaattggggtcaatctgcagctccagtgccaagtactataaacggatttcttgatcctggacgaacaattccatgttctg

SEQ ID NO: 1273 - DNA, 328 bp, Eucalyptus grandis
  misc_feature (1)...(328): n = A,T,C or G
aacaaatcagnggaagaaaatatgcagcatttgaaggacgaagctgcgaacatgatgaagaagatcgagctcctggaagattcaagaaggaagctccttggtgaaggtctaggatcatgctcgatagaggaactgcaacagatagaacagcagctagaacggagtgttatcagcattcgtgctagaaagactcaggtcttcaaggagcagattgacaagcttaaagagaaggagaagatgttgacagctgagaatgcaatcttaactgagaagtgtggaatcaagcccccacaaagagcaaatgagtgcagggatagtccacttctca

SEQ ID NO: 1274 - DNA, 390 bp, Eucalyptus grandis
cttaccgagcactcccctcctgattctaactcgtccattttcgttggtagcagtacatcattggctaataagcctaaatacagagatatccaagcaagagaagccacaagtggttcatcccgccaacactcagatgaagatgatgctgcgacagtggcagatccaagcgaacagagcagatatcctactgatcccaagcgaattagaaggatggtttccaatagggagtctgctagaaaatcacgtaaaaggaaacaagcacacttagccgaacttgaaatacaggctgaccgacttagaggagaaagttctactttgtttaagcaactattagatgctgcacagcactaccgccatgctgatacaaataatcgagtgctgaaatctgat

SEQ ID NO: 1275 - DNA, 384 bp, Eucalyptus grandis
gaattacacccaaccaaaccaaaagagtcataattcaggatccaccttgtttagttaagcaagaataattttcccttcccttttctctttttgagccctttagagttacatgtcttgggtagcaatgacggggaactttgggtggggctcaaactccatggaagaggcgtggaggaaaggtccctggactgctgaggaagacaagttactcattgagtatgtgaagttgcatggggaaggaagatggaactctgtagctaggctcacagggctcaagaggaatgggaagagctgtagattgaggtgggtgaattacttgaggcctgacctgaagagaggtcagataacccctcaagaagagagcgtcatcctagactcccgcta

SEQ ID NO: 1276 - DNA, 382 bp, Eucalyptus grandis
gtcgaccgagtggaagagaggttggcccctccgatctggtcaactcgccaccctctgcgataagtgcgggtctgcatttgaacaggccacgttttgcgaagttttccactcgaaggactccggatggagggagtgcgcttcctgtggcaagcgcctgcattgcggatgcattgcttcgaggatgctgctggagctgctcgattgtggcgggatcaactgcgcgacctgtgcgaaaagttcaggacttctgcctatcgcaagtgatgagaggcctagtgagtttggcatgattaatgttcgtactggtgaactgcaatctagtaccacagacaaccatttcgatagcgacgaggttgataaactgaagcttattcgattgaga

SEQ ID NO: 1277 - DNA, 367 bp, Eucalyptus grandis
ataagatcggatctttcctgctttggcgacgccggaaacccgaattcagtgcccaaacagtagtcgaccgaccgaccgaccgaccgggaagttccgatcatggccgtggagatgtttcaagagccggagtcggcgttcctcgactccgtccggcggtacctgctgtcggaggactccgagtgccggttcttcgagccgccgccgccgccgacccggaacttctgcggcgccggagccccggtgatctgcgggagctccagcttcagcagcctgtacccgtgcctgaccgagaactggggcgagttgccgctcaaagaagatgacccggaagacatggtcctctacggcgtctccgcgacgccctcac

SEQ ID NO: 1278 - DNA, 384 bp, Eucalyptus grandis
  misc_feature (1)...(384): n = A,T,C or G
cacgctcatcggtctgccagaaactcacggagagagagagatggcggagagagaggagaaggggaagtacgacgagatgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgntcccgtcgccgacgagacccctcccgtcaccgacctccccgtcgtcggccatctccctgattgcttgaatggagaattcgtccgggtgggccccaatcccaagtttgccccggtcgccggataccactggtttgatggagaaggcatggt

SEQ ID NO: 1279 - DNA, 368 bp, Eucalyptus grandis
cacggcggcgccgccgggtttcttgggccgagggccgtgccgatgaaacaggcaggtctcgcccagaagcccacgaagctgtaccggggagtgaggcagaggcactgggggaagtgggtggccgagatccggctacccaagaaccgcacccgcctctggctcggcaccttcgacacggccgaggaggccgccctcgcctacgacaaggcggcgtaccggctgcggggtgatttcgcgcggctcaacttcccgcacctcaagcacaaggggtcgcacatccagggcgacttcggcgactacaagccgctccattcctccgtggacgccaagctccaggccatctgccaggacatggccgagaaaccagc

SEQ ID NO: 1280 - DNA, 341 bp, Eucalyptus grandis; identical to SEQ ID NO: 267

SEQ ID NO: 1281 - DNA, 295 bp, Eucalyptus grandis
tgactttcaatgagtttcagaacacatggagtggactttctaaggatattggatccatcaacatggatgagttcctgaagaacatatggacagctgaggagagccaactacagctacaagacatggcgccttctggtaatggaggggaaggaggtggtcaagtagggaatttgctgagacaggggtcattgactctgtcgcggactattagtcaaaaaacagttgatgaagtgtggagagaattattcaaagagacggaggatgtgaaagaagggagtagagaaggaggtgacat

SEQ ID NO: 1282 - DNA, 365 bp, Eucalyptus grandis
  misc_feature (1)...(365): n = A,T,C or G
ttttttttttttttcaagctaagatcaaaccaaaattaaaaaagaatttcacagtatttttatgcaaatgcaatgacaccttatcaaggtttaccaaatgttgaaacaaattatacacacggcctgaggcatccatgaaatcacgcaggcaaaacccgcggctcattttcacgactgcctacctgctcgcgggggttattcaaagcctcgaataccttagtgcaagcacctgagaattccatcaatgccttaaaaacgcgaggcaggccgttcttgagggggttcagtgccatggccttggtgaactcgaccgaaaccgcatacttggcnttcacatcgtccaaccgttttttnagggcctcgat

SEQ ID NO: 1283 - DNA, 428 bp, Eucalyptus grandis
ctccggcgagctcaaactgttcatgaccacgtcgccgtcctcgtaatccttcgcactgatctcttcgccgccaccgcctgccccctcggcctcctccacttcctcccctgcttccccattgccaaacgccctcgccgcctctgccgccgctgcctgtatctctgctgcgtccgtggactccggcacgcggagccgccatgccgagtcggcgaaattgaggcacgcgccccgcccgcggagcgccagcgcagccacgtcgtgggcccgggcggccatctcgggggtcgggtacgtcccgagccatatccgggtcttcttgttgggctcccggagctcgcacacccacttgccgttgttcctgcgccggaccccccggtacacggggtggcgggtctccttgaacacgacccgcccggcccgcttcttcg

SEQ ID NO: 1284 - DNA, 532 bp, Eucalyptus grandis
ggaaaagagaaggcagctttcccgtataaaacccaaacccctccaaattctccccccaattctccagccagggaagggcgagggcggcgacggcgacggcgacgatcatcccatctccgaccagctgatccttccgctccatcgtcgtcatgtacggacgggcggcggagtggagccgctacgaggacaaggtcttcgagcacgcgctggtggcggtggcggaggactcgcccgaccggtggcagctgatcgggaaccgcctgaaccggtccgcgtcgcaagtgttcgagcactaccagaggctggtggaggacattgacgcgatcgagtcggggcgggtcgagccgccgagctaccgcgacgaccacccggcgagctgcggccagattgccttcgagacgaagccccggatcaaggaggcggagaagaagaagggcaacccgtggaccgaggaggagcacaggttatttttgctcgggctgcagacctatggcaagggcgactggaggagcatctcgaggcactttgtcct

SEQ ID NO: 1285 - DNA, 349 bp, Eucalyptus grandis
aaagtcccgagatgccgcgacgcgaattcccctctcgaatgcgctcggaattcgagcgatgatcggagcggcgaccaaccagatcccgccgccgccgccgccgccgcagccgcagcaagccgcgcccgccgccgccgcgatccggttccccgactccgtctacaacgcgctcagggtgggcgccgtcttccagcggctgtcgaagcacctcgccaccatcggcaagggctccggcctgtcggcatcttgcggtacttccatggagttcctgaactcgtgcctctgcctcgccagaggcattgactatgcggtcgcgaacaatgaggttctgcccaaagctcacgaattg

SEQ ID NO: 1286 - DNA, 350 bp, Eucalyptus grandis
cttctgcgagctagggtttctctcgctcctcctcctctctaggccgtgatttctcctcccctcgatcggcgacgtcgccgtcggttcggctctccggtagctcctgctcctcccggctttcatggaggctaaggtgatggaagacgctagcaagtccgaggctcactccatatcggctgcggccttcgtggaaggtggagtccaagaggcctgcgaggatgcttgcagcatctgccttgaagctttctgcgacagcgaaccatctacggtgaccacttgcaagcacgagtatcatctccagtgcattctcgagtggtgtcagaggagttcacagtgtcccatgtgttggc

SEQ ID NO: 1287 - DNA, 344 bp, Eucalyptus grandis
gaaggttggaacatctggtggagcaggcccttgtcctgcaaacagatgcatgtatgcttcataactctatagatatggaaatgtcactgtacactgatcatcaatgtggtaaagaacacatcccctgtcgaactttgcagattttacaatcacataatgatgaagtttggcttgtgcaattttcacataatgggaaatatttagcttctgcatccaatgatcgatcagcaatcatttgggaggttgatgagaatggcagcgtctcattgaagcataaattgactggtcaccagaagccgatttcttctgtctgttggagtccagatgaccgacagcttctcact

SEQ ID NO: 1288 - DNA, 359 bp, Eucalyptus grandis
aacatcttctggctaagcgcgttcagcatcactctcaactactggcgtgaagatgttcaaaggcaaactttcttatctcagaggctaaaagatgttccacccatggcttcttaatctgatccagatgaaccgtggagaaacaaaatcgaagtctcatcaaaaggatcctgattgacctaagaatgacaaggcaaccattcttacggacaaaatccaggtgctgaaggatttaactacggaagttaacaaattgaaagctgaatgtgcagctcttattgaagaatctcgtgagctgatgcaggagaagaatgagctcagagaagagaaatcatctttaaaatctgaagttgaaaatctta

SEQ ID NO: 1289 - DNA, 381 bp, Eucalyptus grandis
tggatccaaagaattcggcacgaggctgcctccaccaccaccgccgtccccaccgccgccaccaccaccaccaccaccaccaccaccttatactgtacaaataatcccttggcctcggccgttatagcctcttactcaaaaatcagtttttacccttttctgttgcgtagtcgtagttttgggccaggggttctattcggtatatgtagagaagtcagtgggcgaaaccgagcgtcgagcggtcggccatggcttcctcttcttctgtagcttccgcgaggaaggacgcggatcggatcaaggggccgtggagccccgaggaggacgaggcgctgcagaggctggtccagagctacggcccccgcaactggtccctgatca

SEQ ID NO: 1290 - DNA, 330 bp, Eucalyptus grandis
ttccaatcttcccttcccttcccatcgcacctctccaaagattccacctttcgtctctctctctcgaagcccaaaccctctcgatctatattgccctcctctcctccgttcatccctcgcaaaaccagacccccggatcagccccgaaagaaggtcggacaagcaagatggcggaagagcaccggtgccaggccccgcgcctctgcgcgaacaactgcggcttcttcggcagccccgcgacgcaggatttctgctccaagtgctaccgcgacctccagctcaaggagcagcagtcctccaacgccaagctcgctttcaaccagaccctgt

SEQ ID NO: 1291 - DNA, 296 bp, Eucalyptus grandis
gcagccgagtcgagcaagaaactaacgaacgcccggtgtcattaggattcataatccacaagaacaaaagaaaaaaggatcatgggaagatccccatgttgcgaaggcaatggcctgaagaaagggccctggtcttctgaggaagacaagaagctccttgattttatccagcagcacggccatggagctggatctctctccctaaacgtgcaggtcttaatagatgtggcaagagctgcagattgagatggataaactacttgtggccggacatcaagagagggagtttctccccg

SEQ ID NO: 1292 - DNA, 355 bp, Eucalyptus grandis
  misc_feature (1)...(355): n = A,T,C or G
gccaagaccctggccggccacaaggccgccatctccgccgtcaagttctcgccggacggcaacctcctggcctcctcctccgccgacaagaccctccgcgcctactccaccgcctccctcgccccgctccacgacttccacggccactcccagggcgtctccgacctggccttctccggcgacacccgcctcctcgccncgcctccgacgacaagaccctccgcctctgggacgtccccacggggaccctcctcaagaccctcacggccacaccaactacgccttctgcgtcaacttcaacccccactccaacctcctcgtctccggctccttcgacgagaccgtcccgcgtctg

SEQ ID NO: 1293 - DNA, 362 bp, Eucalyptus grandis
cccctctaccccccaagccccccaagccgtcctcgtccaccctcagctcccgccgcccggccatccaagtcgcggtccccgcggcgacgagcttcctggcggcgccggctgtcccccgggccgagccgtcgggctccgctggcggcgacgacgacaagcactaccggggcgtgcgccggcggcgtgggggaagttcgcggcggagatacgcgacccgacgcgcaaggggacgcgcgtgtggctggggacgttcgacacggcggtggaggccgcgaaggcctacgaccgcgccgcgtttaggctccgcgggagcaaggccatcctgaacttcccgctcgaggcgggacgcgacgagccgacgt

SEQ ID NO: 1294 - DNA, 360 bp, Eucalyptus grandis
ctctgccgaaccggagaggggccgacaaatgaaaaggaggcggaggaggagatgacgatgccgatgccgatgccgatgatggaccggattagcccgtagagaggaatcggattgctttgccggaacaagagatttcgcgacgacgacgacgacgacgacgacgaatagggaggaaaaagatgcggacgatctgcgacgtgtgcgagaatgctgccgcgatcttcttctgcgccgccgacgaggccgctctgtgccgcgcttgcgacgagaaggttcatctgtgcaacaagctggcgagtcggcatgtgcgcgtcgggctcgccgatcctagtgaggtccaacgttgcgatatatgtgaga

SEQ ID NO: 1295 - DNA, 344 bp, Eucalyptus grandis
cgtctcctccgtcaccctctccctcttcttcctcttctacaagcaccggtcccactatgctggcccgaacctccccccgggcagcatcggcctcccgttcatcggcgaaagcctcgacttcctctccaccgggtggaagggccacccggagcggttcatcttcgaccggatcgcccgctactcctcccacgtcttcaagacttccctcctcggggagccggccgccatcttctgcggcgccgccggcaacaagttcctcttctccaacgagaacaagctggtggtctcgtggtggcctaactccgtcaacaaggtcttcccttcctccacccagacctcctcca

SEQ ID NO: 1296 - DNA, 287 bp, Eucalyptus grandis
gttactacgagagacaaaccaactttgctcctcgtccatccaagattgccaaccctggtgcccttggtctgttctcctttgcatcgacgacgttcattctctccctctacaacgtcaatgcgcgtgacgtaaccacccccaatgttgtgttggcatggccatcttctgtggaggccttgctcagctcctcgctggcatgtgggagtttcctcgcggcaacacctttggagcaacggctttttcctcatatggcgcattttggatgtcgtttgctacgatttatatcc

SEQ ID NO: 1297 - DNA, 557 bp, Eucalyptus grandis
  misc_feature (1)...(557): n = A,T,C or G
ctctctccctctctctctctccctctgcaagtgctggctgctcagatggctgaagcgagagcacatgggttcgtctacgccagcaagaagaggccggggtccgatgatgccgatggcggcgaggacgcgatggtggtggccaagaaacagatgatctccggccccgtggcgggggtgtgggaggacccagcggaatgtccgccatatcatcggtgctgatgcagctgtgcagcagcggcggacacatcgtggcgtcccaggcgctgtacggcgggacccacgccctcctgacccacttcctcccgagggcgtgcaacatcacgacgacgttcgtggacatccgggaccacgccgcggtggcggccgccgtggtccagggccggaccaaggtgctctacttcgagtccgtctcgaacccgacgctgaccgtcgccgacataccggagctctgccggctggcccacgacaagggcgtgacggtggtcgtngacaacacgttcgcgccgatggtcctgtccccggcccggctcggcgccgacgtggtggtgcacaacatc

SEQ ID NO: 1298 - DNA, 500 bp, Eucalyptus grandis
  misc_feature (1)...(500): n = A,T,C or G
gggcatactaaggcaatcgattctgtgtgttgggattctactggcgatttaattgcgtctgtcagtgaggactctgttagagtttgggcagttgggtctggtagtgaatgggactgtgtacatgaattgagctgcaatggaaacaaggcccactcctgcgtgttccacccaacttatccttcacttttggtgattggctgctaccanaccctggagctctggaatatggccgagaacaagacaatggctttgccagctcatgacggactaatttcagcattagcagtatcaaatgtgacgggcctggttgcttcagctagtcacgacaagacagtgaagctgtggaagtgatactttggcatctccaggtatttttcctaagcactcagattggaagactgaaatcgctgttcccatcaaagtgcatgtatcttgtccttgtatcaagttgcctcagtacgcccagttggtgtccgtctcactgatactaatttatagct

SEQ ID NO: 1299 - DNA, 444 bp, Eucalyptus grandis
gagacacaccccgcaatctaccggaggcgccacgaccttgtgagcgcacgggcttgctcgttcgatcttgagtcatgaggctcctgtgcctgctcgcgttgatcccgctcgtcgcagcggagtgcacgtgcgagagcgatcccgaggaacgcaacaggacccgggccctcaagtacaagctggccgccatcgcatcgatcctcgtggcgggcgcggttggggtgtgcctcccgatcgtggggaagaccgtcccggctctgcacccggagaggagtatcttcttcatcatcaaggccttcgcggccggggtgatcctgtccaccgggttcatacacgtcctcccggacgccttcgagaacttgacgtcgccgtgcctgagcgagaccccgtggggggatttcccgttcgcggggttcgtggccatgctcggcgcactcgggacgt

SEQ ID NO: 1300 - DNA, 547 bp, Eucalyptus grandis
ggaagctctagggttgtgaagtacattctcgaatctggcaaagtcgatgtaaatagggcttgtggttcggacaaggtcactgcccttcactgtgctgttgccagtggctctgcttctgcggtggaggttgtcaagctcttgcttcacgcatctgccgatgctaattgcattgatggcaatggaaagaagccaattgatgtgatagcccttccattaaagtcacgcggcgattcaaggaggaagctgatggagctgttgctgaaaggcgataattctgatggggaatttgaatcccacgaggagaagccgattgccgcaccgcaagcatccaaagagggaagcgaaaagaaagagtatcaatttcctgttgatatctctctgcctgacataaatgttgggatttacagtactgatgagttcagaatgtatgctttcaaagtaaagccttgctcgcgggcatactcccatgactggacagagtgcccatttgttcatcctggcgagaatgcgaagaggcgggaccctccaagtacccctacaactgcgt

SEQ ID NO: 1301 - DNA, 483 bp, Eucalyptus grandis
cttcgagtttctttcttcactagaattcgctcccgagtctgttgttgctcgtgtagttttgcttactccgtccttcgtttagctcgctgaccagcgcggagctaggagcggtcgctaaaggattactcgtacaaaacgtaaactcagctctgccaattttcccatggagggggaatcttacttcgagaaagatgaaaaatattctaattgctcaatcttgctcgaattatctgcttcggacgatctcccagcttttgaaaggaaagcgaaagagaagggctgtaacattgatggtgctagcttctggtacggtagaagaattggctcaaggaagatgggtcttgaagagaggactcctctcatggtggcttccttgtttggaagctctagggttgtgaagtacattctcgaatctggcaaagtcgatgtaaatagggcttgtggttcggacaaggtcactgcccttcactgtgctgttgccag

SEQ ID NO: 1302 - DNA, 368 bp, Eucalyptus grandis
ctttcttttgcttcccgttaatccctatttcgttatcaacactttaaaagtcggtgaacagtttaaaattggaatgcatcggaagtagtagttcgacaatttcaactttcaggtgctttttgggaaaaaaattcaatatgagaagatgggtaaaatttgttgcaattcattttcagggatgctgcggtggtttgcattttggcgacgtgcttgttcttaatcttgacagtatggtttggagaactcttgcgaccaccggccaaggacctggcccgagggacagtcacagtgctgttcttgtggggcacaggatggttgtgtttgggggtaccaacggctctagaaaggttaatgaccttcatgtactg

SEQ ID NO: 1303 - DNA, 348 bp, Eucalyptus grandis
ccgagctggtgatgtcgtccggcctcgtctgcaacgacgccgtcagctgggtcacgttccacagcgcctacgacttcgggtacctggtcaaggccctcacccgccgcgagctccccggcgacctcccggagttcctcgccgtcgtgcgggtgttcttcggggaccgggtgtacgacgtgaagcacctcatgcggttctgccacagcctgcacggcgggctggaccgggtcgccgccgccctggagctggaccgggcggtcggcaagtgccaccaggccggttccgacagcttgctgacgtggcaagcgttcaggaagattagggacgtctacttcgccaacgacgacg

SEQ ID NO: 1304 - DNA, 349 bp, Eucalyptus grandis
tgactttcaatgagtttcagaacacatggagtggactttctaaggatattggatccatcaacatggatgagttcctgaagaacatatggacagctgaggagagccaactacagctacaagacatggcgccttctggtaatggaggggaaggaggtggtcaagtagggaatttgctgagacaggggtcattgactctgtcgcggactattagtcaaaaaacagttgatgaagtgtggagagaattattcaaagagacggaggatgtgaaagaagggagtagagaaggaggtgacataaatttgccacagaggcaacggactttgggagagatgacattggaggagttcct

SEQ ID NO: 1305 - DNA, 354 bp, Eucalyptus grandis
cgctgacgaggcggcgctctgcgggggctgcgaccaccgtgtccaccacgccaacaagctcgcctccaagcaccaacggttttcccttctctgtccttcccctaaggaattccctctctgtgacgtctgccaggagaggcgagcgttcttgttctgtcaacaggaccgagccattctctgcagggagtgcgatctcccgatacacacggccaacgagcatacccagaagcacagcaggttcttgctcacgggggtgaagctctccaccacgtcggaagtctacacgtctgccgccagcagtgcctctctgtccaacggatgcgatttcgtccccgacttcaaagtccgaagcat

SEQ ID NO: 1306 - DNA, 513 bp, Eucalyptus grandis
caaagacttgctttcctacatgcacattctgtatgagatctgcccctacttgaagtttgggtacatggcggcgaatggagccattgccgaagcatgcaaaaatgaggatcggatacacatcatagacttccaaattgctcagggcacccagtggaccactctccttcaagcgcttgctgcaagacctagcgggcccccttatgtgcggattacagggattgatgacccggtcaacaggtacgctcgtggggccggattggaagcagttgcaggaaggttggcggtgatctctgagaaatttaagatcccggtggagttcaacggtttgccggagtttgccccaaatgttactcgtgacatgcttgatgtcaggccgggggaagctctcgcagtgaacttcccactccagctacaccacacgccagacgagagtgttgacatcaccaatccaagggatgggctactaaggatggtgaaatcgctttctccgaaagtgatcacattgatcgagca

SEQ ID NO: 1307 - DNA, 348 bp, Eucalyptus grandis
agcagctccgcgtcgtgccggggcagcagcagagcccgcggagcgtcgagtcgctgtcctcgtccccgccggcgtcgccgatgtcgctttcgctgtcccggtcgccgttccgggcggacccgatgggcgagatggtcgcctccctcaggaacctgcagctcgacaaagtgaagtccatgccttgcggcgggtccacttccgggtcgccgagggcctccaggatccgaccggggttctacagcatgcccacgacgccgacacaatccaccccgacggcgcgcgggctggggtgcctggattcctgggagagcccttacgaggaagaaccggcgatggagaaggtggaat

SEQ ID NO: 1308 - DNA, 345 bp, Eucalyptus grandis
ggaaaagagaaggcagctttcccgtataaaacccaaacccctccaaattctccccccaattctccagccagggaagggcgagggcggcgacggcgacggcgacgatcatcccatctccgaccagctgatccttccgctccatcgtcgtcatgtacggacgggcggcggagtggagccgctacgaggacaaggtcttcgagcacgcgctggtggcggtggcggaggactcgcccgaccggtggcagctgatcgggaaccgcctgaaccggtccgcgtcgcaagtgttcgagcactaccaaaggctggtggaggacattgacgcgatcgagtcggggcgggtcgagc

SEQ ID NO: 1309 - DNA, 337 bp, Eucalyptus grandis
cattagagctgacccctgaaagtgttaagcatgggtcacaatctggtcaagaaggcagcactccctctatcagttatgaaaagagttcagaggatggatataattggcgaaaatatggccagaaaaatgttaaaggaaatgaatttgtgcgtagctattacagatgcacgcatccaaactgccctgtgaagaaacaagtggagcgctcgcgtagaggccggattaccgataacatctacttaggcgagcataatcatgctagcccacagaagcacctaccagtggctgtcagctttgctgtgtctatagttgaggagaaaccagagaagccttcccc

SEQ ID NO: 1310 - DNA, 383 bp, Eucalyptus grandis
gccccctttactttgttctctctctccccctctctctctcgccatcgaaatcgaagagccgcctctctctctctctctctctcttttccaagaagatcgagaatttggtcacccttcagcatctgacttaagtttagtctgaaggaggggttgcgtgattcccatgtgatgaagtgggaaacgggagttcccttaccaccatgtgcatcgagtgcgaattggtttttcaacgaggagggaaggaccgcgaaatggacccctgccgagaacaaaatgttcgaaaaagcgctggcggtgcacgatcaggacacgccggatcggtgggatagggtcgcctcgatgatccctgggaagacggtggaggatgtggttaagcactatca

SEQ ID NO: 1311 - DNA, 455 bp, Eucalyptus grandis
gttcatcggcggctacggtgcttccacatctaccccttctctttcctccccctcctcttcttcgtcttctctcttctctttcgagcccgtgtcgttctcggatggctgctcgacaagccccgaccctctgggcttcgagctacccggtccgatcgggctcaaccacctcaccccatctcagatcaaccagatccaagcccagatccagttccaaagcacgaacttgccctcctaccatggccacggctaccacccgagcatgcttctgggaccgaagcccgtgtccatgaagatttccgggtcggcgggcaaaccggcgacgaagctgtaccggggtgtgaggcagaggcattggggcaagtgggtcgcccgagatccggctgcccaagaacaggacccgcctctggctcggcaccttcgacacggctgaggaagccgccctcgcctacgaccgg

SEQ ID NO: 1312 - DNA, 472 bp, Eucalyptus grandis
tgcaaaccctagactccgcatcttcgggaggaacgtctcgctcctgcgaaacctcgtaccgcgcttcggcctcgcttgctcgataatggcagattctcctcgcaagaagtattcaagatccccctcaccttggagagagtaatcaaggtctaggtcgagatccaggtctaggtccccaacctggtacaagcaccggccaaggtcacggtccagaagccatggcagatcaagatccagaagtcatggcagatcagtggatgagaacaatcctggaaacgcactttacgtgaccggtttatccactagggtcactgaaagggacctagaagaccacttttcaaaagaggggaaggttgcttcgtgctttctcgtggtggagcctcgcacacgcatctcccgtggttttgcatttattaccatggagactgttgaggatgctaaccgctgtgtcaagtatctgaatcaagtctgt

SEQ ID NO: 1313 - DNA, 384 bp, Eucalyptus grandis
gcacagtctaacctgattacctacaaaggacctaccatgattgcttgtacactgcaagcaatcgccatattgttaaaggagagcttggagtgggattggtttatcaatctcagtgcttcagattatcctctggtaacgcaggatgatctgctttacgtgttctccaacgtatctagaagtcttaatttcattgaacatgatcagatttctggatggaaattgaaacacagatctaaatcaatcatcatcgatccaggattgtacctgtcaaagaagtatgaagtaacctggagcactcaacgtcgatcagttccaacatctttcaagttgtttactggatcagcatgggtaatggtaactcgctcttttctcgagtattgtata

SEQ ID NO: 1314 - DNA, 428 bp, Eucalyptus grandis
  misc_feature (1)...(428): n = A,T,C or G
ccgcggcgacgacctcctccggcgtctccgggaaggtccacgagtgctcgatctgccacaagagcttccccaccggccaggcgctcggcgggcacaagcggtgccactacgaggcccccgcccccatccccgcctccttctccgccccctccgccgccgccgccccggccgccagcggggtgagcgtgtcggagggcgtggggtccacgcacacgcagagccaggggcaccgcgagttcgatctgaacatcccggcgctcccggagttctcccccaggttcgtcgtctccggcggggtcgacgacnaggtggagagcccgcacccctccaagaagccccggttcctggcgccggcggtgaagacggaagcggcctgaactgggtcggatcgaaaacgcacagaagccaaaccaaaactctgcgagact

SEQ ID NO: 1315 - DNA, 140 bp, Eucalyptus grandis
ccaaggccgcggcggtgcacgagggcgagggagcgaggagcgagctgaagttcataggggtgcggaagaggaagtggggcaggtgggtctccgagatccgcctgcccaacagccgggagaggatctggctcggcttctac

SEQ ID NO: 1316 - DNA, 502 bp, Eucalyptus grandis
gtaaaaaaggggcagccctctgctctgtctgaattgccgtctctcgctacttctctgggcttctttttctttgcttcccttccttaaactctccctctccccgtttcttgtctggtttttctgggtgctctcgcttttcgctgctgaaggagtgagtttgaccgtcgggttcctttcttgatcctccaattcgatcgtcagctcctcgtgtcgacttttttcgggtttcctgtcggcactgttcgattcggattcctcgacggaatggggagtaacatcaacttcaagaacttcagcaccgatccgacgccgacgaataacaggcctcctggcaacacgctgttaacccggcaaccgtcggtgtacacgctgacctttgaggagttccagaactctataggcaaggactttgggtccatgaacatggatgagctcataaagaacatttggtctgcagaggagaaccaatctatggcatctgctagtggcgcttgtggtggcg

SEQ ID NO: 1317 - DNA, 365 bp, Eucalyptus grandis
cgctgacgaggcggcgctctgcgggggctgcgaccaccgtgtccaccacgccaacaagctcgcctccaagcaccaacggttttcccttctctgtccttcccctaaggaattccctctctgtgacgtctgccaggagaggcgagcgttcttgttctgtcaacaggaccgagccattctctgcagggagtgcgatctcccgatacacacggccaacgagcatacccagaagcacagcaggttcttgctcacgggggtgaagctctccaccacgtcggaagtctacacgtctgccgccagcagtgcctctctgtccaacggatgcgatttcgtccccgacttcaagtccgaggcatcgtcctcgttca

SEQ ID NO: 1318 - DNA, 372 bp, Eucalyptus grandis
gtacgataagtattccctctcagtcacccccgccgacgatcctcctgccgaccgcctcctcccccggccgttccgatcctcccggcgacgcgacgacaatggtgaagccgagcggcggcggcggcgatcggggccccccgctggcgccgttcctcagcaagtgctacgagatggtggaggacgaggcgaccgaccccatcatcgcgtgggggagcgccggcgacaccttcgtcatctgggacatcactcaattcaccctccagttgctcccccactacttcaagcactccaacttctccagcttcatgcgccagctcaacatctacggtttcagaaaagttgattcagatcgttgggaattcgcaaatgatg

SEQ ID NO: 1319 - DNA, 363 bp, Eucalyptus grandis
accctgtataatctcaatccttggatttagagaagatttgtccaggacaagaggagccacagatgaagcaatccatgcactgccgacctacaagtttaagttaaagaagaacagaaatagcagtgatacagaaaactcagcttctggggaaggagtaatagctgctggaacagaaagggagcgtgtgatttctggggatgatgctgtctgttgcatatgcttagcaaaatatgcaaacaatgacgagctgagggagcttccatgcaaccatttcttccacaaggagtgcgtggataagtggctgaaaatcaatgcattgtgtcctctatgcaagagtgaggtcgggataatcacgctggtatc

SEQ ID NO: 1320 - DNA, 401 bp, Eucalyptus grandis
atggaatgctatggttatgaggattaatgttgcacttttcgaagtctaggttaccccaattttgtcacttttgctgatttcccactattttcaggccttggttggcttaactggagattcatgggtgaatgtaagtcatgcgcatcacttgtattgtatgatatgtagcaactgcttgcttgagtcacatcacttgtcccataaaccttgtattgtagttctgtgttttcacggccagtaagattcaccttcttatgcatatctctattttcctgatgcatgagatctccctttctgttaagctctcttatttcgtcgatcagaatttgatcctttttcacacgaatacccttcaagctcatttccaattggttttccaaattctgtagttcttttacgct

SEQ ID NO: 1321 - DNA, 364 bp, Eucalyptus grandis
ctcgtgccgcggagtcttatatcagggagcttaacatgaacctacaagctgcagagtctgataaggaggatttgaagaagcagttggatgaactaaagaagcgatcatcggataaagaatgtatcccggtggatcaagatcgcaagatggcaaaacctacgggaagtaggtccactggggtggcaatcgatgtgaagataatgggttgggatgcagtggttcgagtagagagcggccggaaggatcatcctgcagcaaggttaatggtggctcttcaagaattgaacttggagttgcaacatgctagtgtttctgtggtgaacgagctcatgatccacaagccacagttaagatggggagtcag

SEQ ID NO: 1322 - DNA, 413 bp, Eucalyptus grandis
ttttttttttttttttcaaattcaagttgggaattttatgacagtgtagtggaagttctagacattgctcccttgatcctatggaagtagaattaaagctaatcatcaagctaaacatgaactacaactagtacaaaactttacagactcgtcaaaacccacaagtttcaccaccacgcagaagaagttgccatagctcgattcctccaccagagataaagagctccatccttctcttcgattctataattctcgttatattcccttaatagatttctgacagcatcagtaactgcagaactcaatgggaactgttgaaacccggccatcctaaaccttgacctccatttccccaaaagttcatgcctttcaaccctttccgtctcctcacaagctatcatggtggctatgtc

SEQ ID NO: 1323 - DNA, 382 bp, Eucalyptus grandis
caacaggatcctttgtgtactttctttgtatccacagaaagatggatgagagcaataacaaccctggggtggctgataatgccctgggcgacgacgggcagttcaaggagcaagaccggctgcttccgatagcgaatgttgggcggatcatgaagcagaacttgccgccgaatgccaagatctccaaggaggccaaggagacgatgcaggagtgcgtgtcggagttcatcagcttcgtcacaagcgaggcgtccgataagtgccggaaggagaggaggaagactgtgaatggagacgacatctgctgggcgatgcaagccctaggcttcgacgactatgcgagtgctttgaggaggtacctgcatagatatagggaaataga

SEQ ID NO: 1324 - DNA, 377 bp, Eucalyptus grandis
gcttacagggcctgcttggtgggttaattctttttcagctgatatcgttgtccttacggttatcctcttctctccaactcctctggttctctgttccgccaaagaaatggggagacattcttgctgtgtgaagcagaagctgagaaaagggctatggtcgcccgaggaagacgagaagctcttcaactacatcacccgattcggcgtcggctgctggagctctgtaccgaagctcgccggtaagacatgatgacagacgggaaaggagaagctcattcacagttgttttctggggaataagtttctgttcttggagagaatttgattcgaaaaccatgtgaatgatcgaattctctcgtcgaatgcacgactccaga

SEQ ID NO: 1325 - DNA, 305 bp, Eucalyptus grandis
tgattccgagccgagccgccgcggcgtccgacgacgttccggaagtcgccggatcggcaccgaaggggcacgtacaacagcagcagcagccgcaacaggtcggcgccggcgagcccaagtacaggggcgtgcggaggcggcggtggggcaagtacaccgccgagatcagcgaccccgtcaagaaggcccgcgtctggctcggcaccttcgcctccgccgaggaggccgcccgcgcctacgacctcgccgccgtccggttccgcggctccaaggccaagaccaacttccccgcctccctctacgac

SEQ ID NO: 1326 - DNA, 288 bp, Eucalyptus grandis
gtgctttggagtcagcttcctcctctgcttccgaatattgacttctcgagaatacagctgacttctcatattcagagtccgatcgtcggagctcggcgcgttcgatagggaattggctggcttcaggttcctggggtctgtgctttggatgttaagctcgtagagactgaatcgacgatggatggttcgcaaggaaaatcgaatgctccggctccgttcctggtcaagacctatgagatggtcgatgatcctcagacggacttcctggtgtcctggagcgagagcgga

SEQ ID NO: 1327 - DNA, 190 bp, Eucalyptus grandis
gagagagatggggctccggaggatgacgggtcagtcgtcgtcccggtcgggcgacccgggcgcctccaccagcggcggcggcggggcggagtcgccgcggcggttcgcgccggcggctcagccggagataatgagggccgccgagaaggacgaccagtacgcctccttcctctacgacgcctgccgcgac

SEQ ID NO: 1328 - DNA, 259 bp, Eucalyptus grandis
gtggtttcggctcgccgggcccgttcgaggaggagcttccgcggcggggtggtggccatggccgcgcccgggtcggtccggaagtcggaggaggagtggcaggcggtcctgtcgccggagcagttccgtatcctgaggcagaaggggaccgaatatccaggcacgggtgaatacacaagttttctgaagagggggtgtacaattgtgcaggatgtgggactcctctttaccggtctacaactaaatttaactccgctgc

SEQ ID NO: 1329 - DNA, 381 bp, Eucalyptus grandis
gacaggggtttctgtgttggattgtgtgtggagatttggagggacgagtcatggcggatcaggccttggagggaagccaaccggttgatctgtccaagcatccttcaggaatcgttcccactcttcagaacatagtctcaacagtgaatttggactgcaaattggatcttaaggccattgctttgcaagctagaaatgctgagtataatcccaagcgttttgctgctgtaattatgagaataagggagccaaagacaacggcattgatatttgcttcagggaaaatggtttgtactggagccaagagtgaacaacaatcaaagttagcagcgcggaagtatgctcgaatcattcagaaacttggattcccggctaaattta

SEQ ID NO: 1330 - DNA, 347 bp, Eucalyptus grandis
ccgctctcctccgccttccgccaccgcaaatccctccgatcgatcggcacgacacgacccgaaaacgaccccggaaagcctccgctccccgcggcggaagatggcggcgagcgacgcgaagatcgggaggaggttagagggcaaggtcgccatcgtcaccgcctccacgcagggcatcggcctcgccatcgccgagcgcctcggcctcgaaggcgccgccgtcgtcatctcctctcgcaagcagaaaaatgtggatgaggctgctgaaaagctcagggcaaagggtatagaggttttgggcttggtttgccatgtttccaatgcacagcagaaggaaatcccttgtt

SEQ ID NO: 1331 - DNA, 337 bp, Eucalyptus grandis
gataagtccaaggggaaggccaagatcagcgcctcctccgcggccgagcaggagcaccggaagcgcgtgctccgcgagctcaactccctcatcgccgggccctcctccgccgccgccgccgcccccgacgacgccgtcgacgaggaggtcaccgacaccgagtggttcttcctcgtctccatgacgcagtccttcggcaacgacggcagcttgcccggccaggccctgtacgggtcgaccccgctttgggtgtcgggcggggaccgcctcgccgactgcggctgcgagagggcgaagcaggcgcggattttcgggctcaacaccatggtctgcgtcc

SEQ ID NO: 1332 - DNA, 325 bp, Eucalyptus grandis
  misc_feature (1)...(325): n = A,T,C or G
gccaatgggagggaggagcctctgaaccacgtcgaggcggagaggcagaggagggagaagcttaatcagaggttttacgccctcagggccgtggttccaaatgtatcaaagatggataaggcttcactgctccaagatgcggagtcttatatcagggagcttaacatgaacctacaagctgcagagtctgataaggaggatttgaagaancagttggatgaactaaagaagcgatcatcggataaagaatgtatcccggtggatcaagatcgcaagatggcaaaacctacgggaagtaggtccactggggtggcaatcgatgtga

SEQ ID NO: 1333 - DNA, 362 bp, Eucalyptus grandis
cagcatcattataatgtccatgaagagaatcgactgcggcatcacgatttacattagtttcgcctcccttttcgcttgctgcacctgtgcaagcctttgacttcgtagagtcatgtgcgttccttgggcacccttctttgtagctggtggagcagggggggctacaacggatgcttgggagagtgatatgcgcgtctcatcagatgagaaaccgggaatacgaatgttgtggttgcgttcaaggtgtagttgcaggtcgcgcacttccaaagtgtccccaccgcgatgcttagccaagcgacacgcaaagttggtgacggaatcgatgaattcatcagcaatagaaagcaggagatcttcca

SEQ ID NO: 1334 - DNA, 216 bp, Eucalyptus grandis
gtttacgcggttgttgatggattacttaaatgaatttgcttatgatgcacgggttgctggcctttattacagtgtgcatgacaccaacacaggttttcaggtcactgtggttggttatagtcacaagctaaggatattgctggaaaaagtcatcgagaaaattgcaacctttgaagtgagacctgagagatttgttgtgatcaaggaagtggtgac

SEQ ID NO: 1335 - DNA, 326 bp, Eucalyptus grandis
  misc_feature (1)...(326): n = A,T,C or G
gcngaatcagagcaactgggaggcggataagatgctcgacgtttacatgtatgactacttgatgaagaagaagctgcacaacacggcgaagtcattcatgactgaagggaaggtgtcgccggatcccgttgcaattgatgctcctgggggatttctttttgagtggtggtcagtcttttgggatatatttattgcaaggactaacgagaaacattctgaagctgctgcagcatatattgaggcacaacaaggtaaagcaagagagcagcagcagcagcagcagcagcagcagcagcaacagcaactgcagatgcaacaattgcatc

SEQ ID NO: 1336 - DNA, 382 bp, Eucalyptus grandis
aaacaatcgataatccttccttccatctttcctcctcctcccccccttgaaatcccgaatccaccaccacaaccccccaccgccacctgctcgttggtaatctctcttttgcttctggagagggaagtgaagtgatctcggatcagctgactttggagaatgatcctaaagctggtatttctacattgagatcatctttaagagcgctgtggttctctgatggcatctcatccatcaaatcattcgtgtgggcgccctcatcaaggtgcgtttgctgatgctttatacaaagagctgtggcatgcctgtgctgggcctcttgtcacccttcctcgagagggagagcgtgtctattattttccacaaggtcacatggagcagc

SEQ ID NO: 1337 - DNA, 322 bp, Eucalyptus grandis
ctctctctctctaggtcgctctcgattctcgctggtctcgccttcctcggactatcttcgcgatcgcttttggaggatcgttcggggaaattggaccgaagtttcgatttttagcaggcgagatcagctgaatcgggagatcagaataatggagtctcacgatgagacaggatgccaggccccaaaaggcccaatcctctgcattaacaactgtggcttcttcggaagtgctgccaccgccaatatgtgctcaaagtgccacaaggacgtgatattgaaacaagaacaggcacaagcagctgcctcctcgattgagagcatt

SEQ ID NO: 1338 - DNA, 536 bp, Eucalyptus grandis
gttcgacgagttcacagcgagctgacaaatcattgatcatggagcatgagtttagttcggctaaaatcaaagctcttcttgagattctacagtcgcaatgcagaggagaaagtgcaaatgcagagcttcatggtcccatgggctgtgacgatgagtctctttttgaaaatacaggcaccggggattctacatacagagttaaagctgttaagcacacaactgtttattcaagttctcctcctgaaggaccaattaaagcaattgtcttttctcagtggacgagtatgttaaacttggttgaacaaaatctgatccattttggcataaattatagacggcttgatggaacaatgaccctttctgcaagagacaaagctgtgaaagattttaacaccgatcctgagatagtcgttatgctaatgtcattaaaagcaggaaaccttggtctaaacatggttgctgcttgtcatgttattcttttggatctttggtggaatccaaccactgaagatcaagctatcgatcgagctcataga

SEQ ID NO: 1339 - DNA, 438 bp, Eucalyptus grandis
cgacttcaaggagtaccgacttcgctgcgagctgcgcggccacgaggacgatgtccggggcgtatgcgtgtgcggggacggcagcatcgggacctcgtcgcgggatcggacggtgaggctgtgggctccgagcgccggcgagaggcgcaagtacgaggtggcgagggtgctgttagggcacaagagcttcgtgggtcccctggcgtgggttccgcccagcgaggagcttccggagggcgggatcgtgtccggcgggatggacactctcgtgatggcttgggatttgaggaatggagaggcgcagacgttgaagggccatcagttgcaggtcaccggcatcgtgttggacggcggcgacatttgtttctgcctcttgttgattgtaccttaataagatggaagaatggccagcttacggagcactgggaggctcattaa

SEQ ID NO: 1340 - DNA, 533 bp, Eucalyptus grandis
ctttggaggccctcagctcccccaccgctccctccgccccgttccaattcatgaaggactcctcccccgccgccgccgccgccgcctcctcctcctcctccgcctacgacctccccctcgccgagccctgggccaagcgcaagcgctccaagcgcccccacaacccgccctccgaggacgagtacctcgccctctgcctcatcatgctcgcccgcggcggcgccggccggaccctccccccgccgcctccccccgcggtctcttccgaggcggccaaggtggcctacaggtgccccgtctgcgacaagggcttcccctcctaccaggccctgggcggccacaaggccagccaccgcaagcacgcctcctccgcctcggccgccgccgggggtgacgaccagccgaccacctcgagcacctccgcggcgacgacctcctccggcgtctccgggaaggtccacgagtgctcgatctgccacaagagcttcccaccggccaggcgctcggcgggcacaagcggtgccactacgagg

SEQ ID NO: 1341 - DNA, 363 bp, Eucalyptus grandis
gaagcatttgggaagtggacatggaaggaaagatcccgactttggtactgtttctctgcatcttctcggctgccgtcgcggccgagtacgtgcggccccagcctcgcgagaccctcgatttcccgtgggaccgcaagccctcctcttatccccagcaggttcacatttctttagctggagatggacatatgcgcatttcatgggtcactgatggtaaatcttccccttcatacgtggaatacggaacatcgcccggtcgatatgactctacagctcaaggagagagcacttcttatagttatctattttatagctctggaaagatacaccacacggtgatcgggccattggagagcaacactg

SEQ ID NO: 1342 - DNA, 316 bp, Eucalyptus grandis
cctggcctctgccttagctctcctcctcgtcctcgcccttatcaagctattcagacccaaaaccaaccacctgaacctcccgccggggagatttggatggccaatcattggcgagagcctggagttcctccgttcccagcttgaagggagcccggagaagttcatcaaggaccggatgaccaagtacaactcccctgtgttcaagacctcggtgctcggggagccgatggtcatcctgtgtgggccggcggggaacaagttcctgttctcaaacgagggcaagaaggtggtgctgtggtggccgagctcggtccat

SEQ ID NO: 1343 - DNA, 322 bp, Eucalyptus grandis
aggtgttccgatcttcatagaagatgatgatgttgagctgttgtggcctggcagcttccgtcaggcggcacaagcacacgctcctcaaccgagttttgttctaactggaggttctaacataagcttcgtcggggtgaatccaccatctgatgcaggcaattcagctcctgacttgacactgaaactttaaaagaggttaatcttcagttaagtctcatgtttgcttaacccaacattgcacttctgctttcttttggtatattcccaaatgttctttccagttcctttcctgtaagtgctcactccagtatgaagtctataa

SEQ ID NO: 1344 - DNA, 323 bp, Eucalyptus grandis
ctggaccgccacctgaagaccctgaccggccacgtcgccgccgtctcctgcgtcaagttctccaacgacggcaccctcctggcctccgcctccctcgacaaaaccctaatcatctggtcctccaccgccctctccctcctccaccgcctcgtcggccactccgagggcgtctccgacctcgcctggtcctccgactcccactacatctgctccgcctccgacgaccggaccctccgcatctggtcctcccgctcccccttcgactgcctcaagaccctgcgcggccacaccgacttcgtcttctgcgtcaacttcaacccgca

SEQ ID NO: 1345 - DNA, 235 bp, Eucalyptus grandis
cctccgccccgttccaattcatgaaggactgggtaccccgccgccgacgccgccgcctcctcctcctactacgaatacaacctccccctcgccgagccctgggccaagcgcaagcgctccaagcgcccccacaacccgccctccgaggacgagtacctcgccctctgcctcatcatgctcgcccgcggcggcgccggccggaccctccccccgccgcctccccccgcggtctctt

SEQ ID NO: 1346 - DNA, 350 bp, Eucalyptus grandis
gtttggaggaagttcaagctatgggaaggatgctcaaagcccgcaggacatgcatgattcacggccgacaaaacgaccacgtaatgttggggagccttatcgtgacccaggacaggctgagccgatggaggaacatggaatgggatcagcaagtgatcctatggtgcgggcaggcagatcggacggaggtcataatccaattatgtcggccaccgctcccgcaaatgtgtctacggctgggagaggtcgggtagatgataaaaacaatcgcaaattgtcgtgtaaagagtgtcgtaggctaaaactcaagtgcgaccgcgttttcccttgccagtcatgcgtcaagagag

SEQ ID NO: 1347 - DNA, 197 bp, Eucalyptus grandis
cggactcggactggccgagtcaacccacgccccccgcgagtcccgaccccccggcgccatgacgcggcgatgctcccactgctgcaacaagggccacaactccaggacctgccccgtccgcggcggcggcggggacggcgggggcgcggcggccgccccctcctcctcctccccctccacctcctcctctggcgccg

SEQ ID NO: 1348 - DNA, 315 bp, Eucalyptus grandis
cgctggtctcgcttcctcggactatcttcgcgatcgcttttggaggatcgttcggggaaattggaccgaagtttcgatttttagcaggcgagatcagctgaatcgggtgtccttttgcaggtgatcagaataatggagtctcacgatgagacaggatgccaggccccaaaaggcccaatcctctgcattaacaactgtggcttcttcggaagtgctgccaccgccaatatgtgctcaaagtgccacaaggacgtgatattgaaacaagaacaggcacaagcagctgcctcctcgattgagagcattgtcaacaga

SEQ ID NO: 1349 - DNA, 329 bp, Eucalyptus grandis
gagagagatggggctccggaggatgagggtcagtcgtcgtcccggtcgggcgacccgggcgcctccaccagcggcggcggcggggcggagtcgccgcggcggttcgcgccggcggctcagccggagataatgagggccgccgagaaggacgaccagtacgcctccttcctctacgacgcctgccgcgacgccatccgccacctcttcggcaccagagtcgccgtggcgtatcaaagcgagacgcagcttctcgggcaaatgctgtactatgtgctgacgactggttcggggcagcagacgttgggggaagagtactgcgacatcactca

SEQ ID NO: 1350 - DNA, 313 bp, Eucalyptus grandis
tctaggtcgctctcgattctcgtggtctcgccttcctcggactatcttcgcgatcgcttttggaggatcgttcggggaaattggaccgaagtttcgatttttagcaggcgagatcagctgaatcggaataatggagtctcacgatgagacaggatgccaggccccaaaaggcccaatcctctgcattaacaactgtggcttcttcggaagtgctgccactgccaatatgtgctcaaagtgccacaaggacatgatattgaaacaagaacaggcacaagcagctgcctcctcgattgagagcattgtcaacaga

SEQ ID NO: 1351 - DNA, 305 bp, Eucalyptus grandis
  misc_feature (1)...(305): n = A,T,C or G
ccccgcccacttatctgctatcctcgctacttcgctctattagtacctccacaatcccatgcgcaaacgccaacgcaccctcgacatgcacgccggcgcaccaggtcccaacgatgccattgacgcgaacagcgtcggcgacaacgcgttcatcgcggatcacgacgcaattgactcggccggcgacgacgacnacnacnaagacaagcccaagaccggccagaagcaaggccgccgcaaaataaagatcgagtttatacaggacaaatcgagacgccatatcaccttctccaaaaggaaagctg

SEQ ID NO: 1352 - DNA, 517 bp, Eucalyptus grandis
  misc_feature (1)...(517): n = A,T,C or G
gtccctccctagggtttcctcctcgtcgaccgccccttctccgagccctagcctcgcgcggcaaaggcccctccctccgtccctccctccgccgccatgatgcagcagccggtccccggagccgtccccgaccagcagcagcagtaccagcagcagcagcagcagcagtggatgatgatgcagcaggccgcccagcccgtgcccccgccggtgggctggaccccgcagccggtcccgccgcccatggcggcccagtcgatggccggcggcgcggcggccgagatcaagtcgctctggatcggcgacctgcagcctcacatggacgagacctatctcctcaactgcttngcccactccggggaggttctctcagctaaggtgattagaaataagcagactgctctgcccgagggttacggtttcattgaatttatgacccgtgcagcagcagagaggattttgcagacgtacaatggcacattgatgccaaattctgaccagaatttccgactgaact

SEQ ID NO: 1353 - DNA, 472 bp, Eucalyptus grandis
tttttttttttttcagctaaattggagcagctctctttaatacttactgaactagtaatcatggtgaaagaaacttagacagaaagtgaggacattacatcatactcctgaagagcatcaaaggcccagctaacagaaaaaggccgatacggcaacatccaaacaaattaaaagccaaattgtgaccccaacgctaccatccatatacaatgccataactaaatcattcaccttccgacatctactctctttctacttgaatggtgacgtgacttatcttgtactctcttctaatgtagtccacaaccttgtccaggaccatatcggcattggcgtcacgctttattttgacatggcaggctaatagtacctttccaaccgttatagcccagatgtgcaattcatggactgcaatcacttcatcgatcttgcaaagtccactctcgagcctagtggcatcaatctctctagg

SEQ ID NO: 1354 - DNA, 472 bp, Eucalyptus grandis; identical to SEQ ID NO: 249

SEQ ID NO: 1355 - DNA, 503 bp, Eucalyptus grandis
cacgcatccaacttcatcaggaaggagctgagggccatcatcaagcagaggaagctggacttggcagaaggcagggcgtcggcgactcaggacatattgtcgcacatgctgttggccacggacgaagatgggaagcacatgaacgagatggacattgctgacaagatcttgggcttgttgatcgggggccacgacactgccagtgccgcctgtaccttcatcgtcaagtaccttgccgatcttccccaagtctacgagggagtctacaaggagcaaatggagatcgccaagtcaaaagccccaggagagttgttgaactgggatgacatccagaagatgagatactcatggaatgtggcgtgtgaggtgctgcgattggcgcctccgctccagggagcattcagagaagccctcaatgacttcatcttcaatggtttctccattcctaaaggctggaagatctattggagtacccactcgactcacaggagcccagagtactt

SEQ ID NO: 1356 - DNA, 360 bp, Eucalyptus grandis
atcttcttctcccccaaaaccccatcggacccaaaaaccctaacgaagatgaatagggagaggcttatgaagatggcgggttctgtccgcactggtggaaagggtaccatgagaagaaagaagaaggctgttcataagaccaccacgacagatgataaaaggcttcaaagcaccctgaagaggattggggtgaatgccatccccgcaattgaagaagtcaacatttttaaggatgatgtagttatccagtttttgaatcccaaagttcaagcgtctattgctgcaaatacctgggtagttagtggttctcctcagaccaagaagctacaggatatcctccctggcatcatcaaccaatta

SEQ ID NO: 1357 - DNA, 377 bp, Eucalyptus grandis
aaaacaacctccctcagctcctcttcaccactggtttttgagatgatctgtgtgctcggcgccgttgattattatgtcttattctgacttgctgaacctgctgtttgccgtgggcgtttggtgcaccgcgtatattgcggctgccgttctcgagtcgctccgggtcttccatactctctgttcgttttgatttcgatagctgttttcgaaggctaagatgggctacgcacagctggtcatcggccctgccggcagtggcaagtcgacttattgctcgagtttgtatcaacattgtgaagctattgggcggacaatacacattgttaacctagatcctgcagcaaagaactttgactatcctgtggccatggatatca

SEQ ID NO: 1358 - DNA, 360 bp, Eucalyptus grandis
ctctgacgatggatataactggagaaaatatggacagaagcatgttaagggctgtgaatttccacgcagctattacaaatgtacctatcctaattgtgaggtgaaaaagcttttcgaacgtgctcctgatggacatattacagagattatctacaaaggaactcatgatcaccctaaaccacaaccaagccgccgctttactggaggagcgaccatgccaatccaagaagaaagatctgataggttttcatttatacctgcagtggagagcacatcgaccgtatatggcgagacatcttataatgttgagactgatggtactcctgaactatctcctgttgctgagaatgacgaaactat

SEQ ID NO: 1359 - DNA, 347 bp, Eucalyptus grandis
gttccaccacgctcgtcccgctcccgcatttctgaaatcgcgatcgccgtcttcaacctcgggaaaaaccctagcggatcccctccggtcgccaattcatctcctgatccccgccgtcgcccatgccgccgtcgatcccgccgcgccccctctcgccgtcgatctccagctgatcgcgcctccgattttgctccccgccccggcgcgatggtggtctgcaaatgccgcaaggctacgaagttatactgcttcgtgcacaaggtccctgtgtgtggagaatgcatatgctttacggagcaccaaatatgcgtggttcgtacttactcagaatgggttatagatggcga

SEQ ID NO: 1360 - DNA, 326 bp, Eucalyptus grandis
  misc_feature (1)...(326): n = A,T,C or G
ctcctcctccccctccacctcctcctctggcgccgcggcngcggcggcggcctcngcctccggcggcggggtgaagctgttcggggttaggttaacggacgggtcgatcatgaagaanagcgccagcgtggggtgcctgtccgccgcccactaccactcctcgtcctccgccgcggcatccccgaaccccggctcgtccccgatcgacgggagcgacggctacctgtccgacgatcccgcgcccggctcccgctcgtccaatcggcgcgtcgagaggaagaaaggtatcgaggattttgattgacgcgcggctccctgattccctg

SEQ ID NO: 1361 - DNA, 526 bp, Eucalyptus grandis
atcccactccccatccgctccgcctgaatcctctcctgggaaaattagggtttctgcaagctccggattttcgctcccttttgggggtcctcgatttgatgataagccatggatgcctggggtcgtgctagtgtgctgcgcgcgctcctgtggctcgccttgcttggggttggccgcacggcgtcggcgagcgtcgtcctgatcggcagcaacgtcaccctctccttcgccgccgtcgaggctgaattcgctccgccgattaagggttctggggtttgcggcgtgctgtatcttgcggacccgatcgatgcgtgctctcaattggtgaatgaggccaaccggttgccgaatgctagctcccctttcgccctaattgttaggggaggaggatgtagtttcgaagagaaagttaggagagctcaaaaggctggattcaaagcggctattgtctatgacaacgaagctgatggcaacttggtgccaatggctggacattcagctgggataaagatccatgctgtgttcg

SEQ ID NO: 1362 - DNA, 307 bp, Eucalyptus grandis
gacccgcatacccgctgccaatctggaggacctatttgacaaccataacatggctcgaatacgggacgtatgggccccgaatcttgagatagagatgcagaacatccgcgaggccatcgagaaatactcgtatgtttcaatggacaccgagttcctggagtggtggcgcggcccataggtaacttcaaaacgtcctcggactaccactaccagacgatgcgctgtaacgtcgaccttctcaagatcatccaagtcgggatcacgctggcagacgaggaggggttgttcccgcaggactgctctacgt

SEQ ID NO: 1363 - DNA, 353 bp, Eucalyptus grandis
  misc_feature (1)...(353): n = A,T,C or G
cttgaaggtgacttcaacaaacacgatgaggataactggatccaagaagagtttgagaaccatgtggntaaacaacgtgaaggaaagaggccgcttttgactggagatctcctagtgaagctcgaaagaggtgttgggaagctgggaagtttcatgtttactgacaattccagctggaataggagtaaaagtttcaggatagggcttaaggtggcctcaggttattgtgggaacacacgaatccgagaagcaaaaacataagccttcactgtgagggagcatagaggagaatcatataagaaacattatccacctgcacctgacgattaaatctggaggttggagaagatcgc

SEQ ID NO: 1364 - DNA, 324 bp, Eucalyptus grandis
cctcgcccggcaaaaccgattcgaggtcgagagtcgagtaaagatgaatgtggagaagcttatgaagatggcgggttcagtccgcactggtggaaagggtaccatgagaagaaagaagaaggctgtgcacaagacaactaccacggatgacaaaaggctccaaagcactctcaaaagaattggggttaatgctattcctgcaattgaggaagtcaacattttcaaggatgatgttgtcatccaatttgtaaatcccaaagttcaagcctctattgcagccaatacatgggttgtcagtggtgctcctcagaccaagaaattgca

SEQ ID NO: 1365 - DNA, 306 bp, Eucalyptus grandis
gacaaattgatgaaacatgaatatggatgggtgtttaacactccggttgatgtaaagggcctcggtttgcatgattactatagcatcataaagcatccaatggacttgggcagtgtgaagacaaggctgaaccggaactggtataagtcaccgaaagaatttgcagaggatgtcagacttacgttccgtaatgccatgacatataaccctgaagggcaagatgttcatgtcatggctgagattctgtacaagatatttgaggatagatgggccattatagagtcagattataatcgtgaaatgcgg

SEQ ID NO: 1366 - DNA, 345 bp, Eucalyptus grandis; identical to SEQ ID NO: 194

SEQ ID NO: 1367 - DNA, 292 bp, Eucalyptus grandis
cgaaggtctcacatttatgaaactcaaggtctgaaggatgcatttattatatgtctcaatgccgtagagtccattgatgcaactaaaaaggggagccttgctaggttcataaatcattcatgccagccaaattgtgagacaaggaaatggaatgtattgggggagataagagttggcatatttgccaagcatgacattcctgctggatctgaattgtcatatgattataacttcgagtggtatggtggagccaaggtccgttgtctctgtggtgcacctagctgtctggttt

SEQ ID NO: 1368 - DNA, 278 bp, Eucalyptus grandis
ctgcaacgacctgacggcgttgcggcggttcctgccgtcgaaccaccaccaggacgaggaggacgaggaggacgggcgggcgcccggggaggacggcgtgctgggctgcgacgagttccggatgtacgagttcaaggtgaggaagtgcgcgcgcgggaggtcgcacgactggacagagtgcccgtacgcgcaccccggcgagaaggcgcgacgcagggacccgcgccggttcttctactccggcactgcatgtcctgatttccgcaaaggcgcgtgca

SEQ ID NO: 1369 - DNA, 328 bp, Eucalyptus grandis
ttcacttcgtcgcctgcctcgtcgtcctccctgtcctcctcgcgaatctccatcggcgagaactctgataaagcatccctcggctatctgtcggatggcctgctgggtagatcccaagagaagaagaaaggagttccatggacagaggaggaacacagaaccttcttggtggggcttgagaagcttgggaagggtgattggagaggcatctctaggagctatgtgaccacaagaacaccggcccaggttgcaagtcatgctcagaaatatttcctccggcaagtgagcttcaacaagaaaaagcggcgctcgagcctctttgacatgg

SEQ ID NO: 1370 - DNA, 96 bp, Eucalyptus grandis
  misc_feature (1)...(96): n = A,T,C or G
tgaattcggcggggagttaatgaatccaagaagcaactggctaattgtatataatgatgatgagggngacatgatgcttgttggggatgacccgtg

SEQ ID NO: 1371 - DNA, 320 bp, Eucalyptus grandis
agagagagaagaacccttcttcacaaacctctctctctctctctctctctcttcccctgtgtctgtcgattctcgctggtctcgcgttcctcggattgtttcgatcgcgtacgctgaatcgcgccgggaattcggccgtggtttcgattttgtcgagcgagatcagcagaatcaggagatcaggacaatggagtctcacaatgagacaggatgccagcctccaaaaggcccaatcctctgcatcaacaactgtggcttctttggaagtgctgccactgccaatatgtgctcgaagtgccacaaggatgtgatgctgaagc

SEQ ID NO: 1372 - DNA, 343 bp, Eucalyptus grandis
cggccgcctgcagctttcccctccgtgtcgacacgacgacgactccgccgccgctcccccctcgcgtcgtctctccttctctcgccctgtatatatctctcgtcccccgacaaaaaaaggagaaatctgaagagaggggactgaaattaggttattgagaaggattcttcccgtgaccaatcttttggagaaagatggcttctcaatttaatttcaaaggcataaccgatgcatcgcaagctgaaggagtagctgggaaatcacacggaaatcactctttaactcggcagccatcaatatatgctttgacttttgatgagtttcaaaacacatggggtgggct

SEQ ID NO: 1373 - DNA, 310 bp, Eucalyptus grandis
ctccccctcgccgagccctgggccaagcgcaagcgctccaagcgcccccacaacccgccctccgaggacgagtacctcgccctctgcctcatcatgctcgcccgcggcggcgccggccggaccctccccccgccgcctccccccgcggtctcttccgaggcggccaaggtggcctacaggtgccccgtctgcgacaagggcttcccctcctaccaggccctgggcggccacaaggccagccaccgcaagcacgcctcctccgccgcggccgccgccgggggtgacgaccagccgaccacctcgagcacct

SEQ ID NO: 1374 - DNA, 306 bp, Eucalyptus grandis
  misc_feature (1)...(306): n = A,T,C or G
agcaagcaaaagaagaaaccagaaaaatcagacaccccgatttcacattctctactacagaattccggagatggtgaagagagacagagaggacacggaggtcgaagccctggccagggccaattgcttgatgctcctctcccgtgttggcgagagcaccgactcggcgtcgccggaccgcaaatcgcggcctacagagcgaatgttcgcctgcaacacttgcaaccgcgagttctnctcgttccaggcgctcggagggcacaaagccagccacaagaagcagaagctgatctccggtgacctctt

SEQ ID NO: 1375 - DNA, 273 bp, Eucalyptus grandis
cctcctcctcctgctgcggctacgacctgcccctcgccgagccctgggccaagcgcaagcgcttcaagcgcccccacaacccgccctccgaggacgagtacctcgccctctggctgatcatgctcgcccgcggcggcgccggccggaccctacccccgccgcctccccccgtggtctcttccgaggcggtcaatgtggcctacaggtgccccgactgcgacaagggcttcccctcctaccaggccctgggcggccacaaggccagccaccgta

SEQ ID NO: 1376 - DNA, 319 bp, Eucalyptus grandis
gacaaatgagaaccctaggacgccttcagtcgacaaggagagcactactccaaggacgtcgaaatcagaagaggagcagagcgacacgagcaactcgcaagagaaggtgctcaagaaacctgacaagatacttccttgccctcgatgtaatagcatggacaccaaattctgttactacaacaactataatgtgaaccagccccgacacttctgcaagaactgccagagatactggacagctggtggaaccatgaggaatgttcctgtgggtgctggccgccgcaagaacaagaactcggcatctcattaccgtcatcta

SEQ ID NO: 1377 - DNA, 339 bp, Eucalyptus grandis
tctctctcttcgtttctcccgtttctctctctctacctctcgccaagaaaccgccaggaaaggaaggaaggtaaaaagaaaagaaaaggaagccatggctccgagagaaaagcccagcgtcgccgccatcccaaaccctaacggcgctaaggaaatccgtttccggggcgtccggaagaggccctggggccgctacgccgccgagatccgggaccccggcaagaagacccgggtgtggctcggcaccttcgacacagccgaggaggccgcccgcgcctacgacaccgccgcccgcgagttccgcggcgccaaggccaagaccaacttccccacctccgc

SEQ ID NO: 1378 - DNA, 343 bp, Eucalyptus grandis
ctttgacgcgcattaaattcccgcgactccgaaatatctcacctccctctcccgcagaatccctagattccttccttagctcctcctctctccctctctctctctctctctctatagaaaattcctcatctttggtggcggcgagaggcggttgcgagggatttccggtcgcgggtgtatgtgcgtggggttggggttggggtgggggagatgaagattcagtgcaacgtgtgcgaggcggcggaggcgagcgtcctctgctgcgccgacgaggcggcgctctgctgggcctgcgacgagaaggtgcacgccgccaacaagctcgccagcaagcaccagcgcg

SEQ ID NO: 1379 - DNA, 368 bp, Eucalyptus grandis
ctcgattctcgctggtctcgccttcctcggactatcttcgcgatcgcttttggaggatcgttcggggaaattggaccgaagtttcgatttttagcaggcgagatcagctgaatcgggagatcagaataatggagtctcacgatgagacaggatgccaggccccaaaaggcccaatcctctgcattaacaactgtggcttcttcggaagtgctgccaccgccaatatgtgctcaaagtgccacaaggacgtgatattgaaacaagaacaggcacaagcagctgcctcctcgattgagagcattgtcaacagaagttccaacgaaaatggtaaaggacctgtggcaactgaaaattggatttgcaagctg

SEQ ID NO: 1380 - DNA, 362 bp, Eucalyptus grandis
gaggctcagtacttcgtgtagccatggggcatgaaagtgaagcatttgaagagtttgttgatgcgcacaaaacttgcttgaatgatctcatgttcttccctactcgtaatgccttggactctcaagtgttgctgcaaatgcagaaaagcttgctgccttgcagaacgaatatcattttgctaaagcaaggattgatgaagatcatgagaaggcgcagcgactggagaagaaggtcaaaactctcacattcggctatcagatgcgggagaagactcttcgagaccaaattgagtcaaccttcaagcagctggacactgcagggacagaactcgagtgtttcccagctctgcagaagcaagagc

SEQ ID NO: 1381 - DNA, 459 bp, Eucalyptus grandis
tgctcgcaaagtttgtttctttgctcacaagcccgaagaattaaggcctgtctatgcttcgacgggatcagctatgccttccccaaaatcctactcatcaagtgggctggacatgtccacattgagtcctctctcaatcagttctccgtcagcatcgttgcctgttacttcaacagcacccatgtctcctcttgcagcctcgtcatctccgatgtctgtgaacatgtggcagagcaaggctaacaagctctccccgccaatgctgcagctctcaggtagtaggctgaagactgctttgagtgctagggacttggacctggagatggaattgcgtggtctagagagtcagatggccactcaacagcatcagttgatggaagagatatctcgtctctcctcaccatcatcctgctttagtagtaggattggggaagtgaaacccactaacctcgatgacgt

SEQ ID NO: 1382 - DNA, 319 bp, Eucalyptus grandis
aaaaaaagaagcataacttcaacgagcgaatctccctctgtctctggttcatctttggttcttcaggctcagaaccatggctcagactgttgttctcaaggttaaaatgtcatgtcaaggctgcgctggagctgtcagaagggtcctggaaaaaacggaaggtgtggaaacatttgacatcgatctgaaggaacagaaggtgacagtcaagggcaatctgcagcccgatgctgtcctgcaaaccgtctcaaagtccggaaaacaaactgctttctgggaagcggaagccccagcccaacccgaagtgaagcccaccgaa

SEQ ID NO: 1383 - DNA, 408 bp, Eucalyptus grandis
cttgctttcctcttgttggtccaacgcagagagaagagagagagagagaggtggaagaagatcaatctcgtatctgaccggcgaccggtggtgctcttcatcttctccacctcatcctctctctctagagaaccgaaagccggcgtctttcgtcgtctccggttcggcatgaacgggaaggccaacgtctccaaggagctcaatgcgcaccacagaaagattctcgaagggcttctcaaattgcctgagaacagggagtgtgctgattgtaaggccaaaggtccaagatgggctagtgtcaatttagggatatttatatgcatgcaatgttcaggaatccatagaagtcttggggtacacatatcgaaggtccgatcagctactttggacacatggcttccagagcag

SEQ ID NO: 1384 - DNA, 315 bp, Eucalyptus grandis
gcaaaattgggccccttcaaaattactgggaggtcttctcctaaatgcctagaaggatccgatggaagaaatttgcagctacaattcaggaccaggttgtcgctcccgctctttactggaggcaaagtggaaggcgagcaaggtgctgcaatccatgtcgtcttaatgaatgcagatacaggctgtgctgtcacatcaggtccagagtcctctgtgaagcttgatgttgttgtccttgaaggggatttcaacaatgaagatgatgacacttggactcaggaagaatttgacagtcatgtagtgaaagaacgtgaa

SEQ ID NO: 1385 - DNA, 375 bp, Eucalyptus grandis
  misc_feature (1)...(375): n = A,T,C or G
gttctcgagaacccagctccatcccagttcgacccatctgagaacaagtcaacccagatcgtcaaaatcgaatcttgactcgagggagaagcggagaatgacgaagcgcagcgcagccaaggccgcggcggtgcacgagggcgagggagcgaggagcgagctgaagttcagaggggtgcggaagaggaagtggggcaggtgggtctccgagatccgcctgcccaacagccgggagaggatctggctcggctcctacgacacccccgagaaggcggcccgcgccttcgacgccgccgccttctgcctcggccgccccgccgcgaagctcaactnccccggcagccccccggagatctccggcgcggcgtccctctc

SEQ ID NO: 1386 - DNA, 332 bp, Eucalyptus grandis
ccgaataccaccaccgcgaaaatgatgatcggcgagtcccgccaccaccccctccaccccacgacggtttgcatccctcctccgctgtggccgtccctcgacgatcccgccgacgagatctcccccgccttcgacgcggaccacctcgccgccgtcgccgccgcttctagtccgtacgctctgcaggacatcatcgcggcgctgcgccgccaccagtccgacccggactccgacggccccgactcgccggtggacctctacacgtccgatcacttccgcatgtacgagttcaaggtccggcggtgcgcgcgcggcaagtcccacgactggac

SEQ ID NO: 1387 - DNA, 320 bp, Eucalyptus grandis
  misc_feature (1)...(320): n = A,T,C or G
ggaacctttttggtttttttttggcgctcgggcaccggttcgggagtttggctgcaatggctggntgaggcacagaatgaggttgcagtatcaagtgccttgttcaccgttcccaatcgtccttccaaagttgggtcacaattggaagctgtggataatctgaaagagttgcaggtcctggaaaatgaccagacacctaaggtgaggaagccttacaccatctccaagcaaagagagaaatggacggacgaagagcatgagaggttccttgaagctttgaaactgtatggccgcggttggcgtcagatagaagagcatgt

SEQ ID NO: 1388 - DNA, 409 bp, Eucalyptus grandis
ttcagttagtgctcttccaccctctaaagcctcatttcttcgtcgcaacgcagcagtaccgtccggatatacaacctgtccgagcaaaaattgttgaagacgctgacgcctggtatcaaatggatatcttccatggatgttcacccgtcgggcgatcatctcatcgttggtggctacgaccgaaaactgtgctggtttgacctggaactcagtgacaagccatacaagattttacgatatcacacacgcgccattcgttctttggcgttccacccaacatatccactatttgcgtcctcgtcggacgacggcgctatccaggtgttccattccagagtgtataacgacctgatgacggatcctttgatcgtccctctgaaaattctccgaggacatactgtaaaggaag

SEQ ID NO: 1389 - DNA, 313 bp, Eucalyptus grandis
cggactcggactcggccgagtcaacccacgccccccgcgagtcccgaccccccggcgccatgacgcggcgatgctcccactgctgcaacaagggccacaactccaggacctgccccgtccgcggcggcggcgtcggcggcggggacggcgggggcgcggcggccgccccctcctcctcctccccctccacctcctcctctggcgccgcggcggcggcggcggcctcggcctccggcggcggggtgaagctgttcggggttaggttaacggacgggtcgatcatgaagaagagcgccagcgtggggtgcctgtc

SEQ ID NO: 1390 - DNA, 329 bp, Eucalyptus grandis
  misc_feature (1)...(329): n = A,T,C or G
cgagaatccagctccatcccagttcgacccatccgagaacaagtcaacccagatcgtcaaaatcgaatcttgactcgagggagaagcggagaatgacgaagcgcagcgcagccaaggccgcggcggtgcacgagggcgagggagcgaggagcgagctgaagttcagaggggtgcggaagaggaagtggggcaggtgggtctncgagatccgcctgcccaacagccgggagaggatctggctcggctcctacgacacccccgagaaggcggcccgcgccttcgacgccgccgccttctgcctcggccgcccgccgcgaagctcaacttcc

SEQ ID NO: 1391 - DNA, 156 bp, Eucalyptus grandis
cggacccgatgggcgagatggtcgcctccctcaggaacctgcagctcgacaaagtgaagtccatgccttgcggcgggtccacttccggctcgccgagggcctccaggatccgaccggggttctacagtatgcccacgacgccgacacagtccaccc

SEQ ID NO: 1392 - DNA, 555 bp, Eucalyptus grandis
  misc_feature (1)...(555): n = A,T,C or G
gaagctcgacacgcgatttccggctgcaaggatcaagaagataatgcaagcagatgaagatgtagggaaaattgcattagcagttcctgttctagtctctaaagcattagaattatttttgcaagacctttgtgaccgtacatacgagataacacttcaaaggggagcaaagactatgaattcgctgcatttaaagcattgtgtgcnaagctataatgtgtttgatttcctgagggagattgtcagcagggttcctgactatggtcatggtcatggtcattcagatgctgtctctgaggatagaacagtgtccaggagaaggaaggccaccatcgatgatggtaatgacactgatgaggaatccaagaagagcaggatgcttgagatggcccatactggcagcagtggcagaggaagaggccgtggccgaggaagaggccgcgggcgtggtggccgagccactgagagggagactgcgcaccatgaaactgaatcatctgagccgaccacatctctgcaacctgtcaacaagaacattgtcaatcaaggaacagt

SEQ ID NO: 1393 - DNA, 525 bp, Eucalyptus grandis
cgcggatcccgcgagcgtctcccccaagtgccccttcggctacgacgcgccgccggattccggggccatctcccccaagtgccccctcggctacgactcgcagacgttcaagctcggccctctcagctgcatgatctgtcaggcccttctgttcgattgcgccaaatgcgtgccctgttctcacgtcttctgcaaggcatgtatattgcgatttaaggactgcccactctgtggagctgatattgagggcacagaagccgactcgaatcttcagagcacagttgatcggtttatcgaaggccatggtagaattaagaggtcccatgttgagaatgttgataaagaggaagttagcgcgaaggagacggtgatatatgaggacgtgtctttggaaagaggtgctttcttggttcaacaagccatgcgggcttttcgtgctcaaaatgtggaaagtgccaaatcaagactcagtgtctgtgctgaggatatcagagatcagataacaagaacaggcagcacgtcaga

SEQ ID NO: 1394 - DNA, 443 bp, Eucalyptus grandis
caatgtgtgggggcgccatcatctccgacttcatccccaaccagagggcccgccgattgacctcggacttcctgtggcccgatctgaagagatcggccggcaagcagtcgaggcggccggccaggtcggaggtcgtcgatgtcgtggacgatgacttcgaggccgacttccagggcttcaaggacgagtccgacgtcgaggacgacttcgacgacgaggtcgaggtcgacgtcaagcccttcgctttctccgccgccgagcctcggtactccaaaggctcttcaaccaccaaatctgtggagtataatgggcaagctgagaaatctgccaagagaaagaggaagaaccaatataggggaatcaggcagcgtccatggggaaaatgggctgctgagatccgtgacccaaggaaaggggtccgagtttggcttgggacgtttaac

SEQ ID NO: 1395 - DNA, 409 bp, Eucalyptus grandis
ccgaaatggcccagttggtatgcggaggctgccacaccttactcatgtacatccgaggagcgacaagcgttcagtgctcctgttgtcacacagtcaacctagccttggaagcaaatcaggtggcacacgtcaactgcgggaattgcaggatgctcctgatgtaccaatatggcgcacggtcggtcaaatgcgctgtttgcaattttgttacatcagttggtgcttcgtcaagcacactggaacagaagttcaccagctagaattagcaataaacctaccggtcacaggcctcacaactcatggttataagacttctattctactgccgctgccgccgccactgcacatcagcgtcatgaacgcaagctgagaaaatccctactagtttaacttgtatagagttaaaatc

SEQ ID NO: 1396 - DNA, 462 bp, Eucalyptus grandis
  misc_feature (1)...(462): n = A,T,C or G
accatttcttccgaacacaagaggaggcgggtggtggtggtggtgttgctgcttctggtgccgtccacttccttcttcccacctccatcttcatctctccctccctctctctctctgaatctaccgaacccttctcgccgaaggnnnatnagagagagagagagagagagagacgggaagaccatcgctttcggccatcgcgtgcacgagcagtcatgaggagaggcagatgcgccgccgcggccgcgaagagggaggcggccgagatagcgccgccgccggtgccccatgcggctgcggcggcggcggcggaacccagatacaggggcgtccggcggaagtcgctgggccgatacacggccgagatcagagaccccgggacgaagaagctcgtgcggctcggcactttcggctcgccggaggaaagcggcgcgtgctttcgacgccaaggcccgtggcgtt

SEQ ID NO: 1397 - DNA, 407 bp, Eucalyptus grandis
ctctcgctctgcaatttcacaacgagtccgtcagtagtaggacctcattcacagctccagaaacccgaaaagatgagccaatccaccatgttggtagcggaagagaccatattttctccgccccctttgtataaccagcgaaaccatccccacgacggcgcctctgggctcaacccgttcctcacccaggagcactggggcgacctccctctccagctcaacgactccgatgacatgctcatctacaactccctccacgacgccctccactccggctggtcccctttcgactccgtcatcaccgccgtccaccccgagccccagccccaccccctcctccccgccgcttccgtccccacctccttcgcctccgacgagccctgtcgctccacaacgctttcgcctct

SEQ ID NO: 1398 - DNA, 456 bp, Eucalyptus grandis
ccgacctcctctctccacgcggccactgtcccgtcgcgcgaattcgccccgccgtcgtaggagaccgcatcctccgccgccgcggcgatggccccagcttcattccctgcgctagcaacgcatttcaatggaagtatgctcaatgatactaactcatctggtgaaagtcacacacgtaatggaaggccacgaggagatgccaggggaaggaatcaattacttcctcgttactggcccaggataacagatcaagagctacaacaaatctcaggagactcgaactctgtaatcactcctctgtttgagaaaatgttgagtgctagtgatgcaggtaaaattggacgtttagtgctgccaagaaaatgtgccgaggcctattttccgtctatttctcagcttgaaggattgccactcaaagttcaggatgccaaaggctcggagtggatatttcaatta

SEQ ID NO: 1399 - DNA, 474 bp, Eucalyptus grandis
aagttgaggaagtcgagttggagttctcggagggtgaaatggcggcttgattgagggccttgttggggcttgattggaaggatttgatggagctgttcattccaaaggcattgtcttcttgagatgcggacttcaaaccagcagcgtccttgttggatttggtggcggccctgcgagtcgtgccgttctcagacccagcttgctctcggctcttggtctcttccaagtacatttcttcgaccatgggcttccagaggcgaacccgagcgttgatgaaccagttagacacctggctcctggttagtcccgcttgttttgcgagcatgtgtttgtccgaatctttgggatagctgcaattgcaacacgccagaatgttgaatgtacaattgcaactcaaacataaagcgtggtcgtcaaccatgaacatggtttaaattactcctatgatctacagttgatcgaacttacctttgg

SEQ ID NO: 1400 - DNA, 443 bp, Eucalyptus grandis
  misc_feature (1)...(443): n = A,T,C or G
gccccgtcttccncaaggccatcggcgagctccacggccactccggcatcgcgcggctcatgctcttctacgcccgcagcctcttcggcctcgtcgaccaccggaatggcatgggcgtcgcgaacgccggcctcgtgtacttcgacggccacctcctcgcgatgtccgaggacgacctcccctaccacgtgcgcgtcacgcgctccggcgacctcgagaccgtcggccgctacgacttcgccggccagctcgactctccgatgatcgcccacccgaagatcgacccggcttccggcgagatgttcgccctcagctacgacgtcgtccggaagccgtacctcaagtacttccgattctccaaggacggcgagaagtcccccgacgtcgagatccccctggctgagccgaccatgatgcacgatttcgccatcaccgagcgcttt

SEQ ID NO: 1401 - DNA, 481 bp, Eucalyptus grandis
atgagctgagaatagccgaagcatggatgtggagatagcggcgacagcggcgggacgctgaatatactctccttgttcccttccccaacgtcccagaaccccctccagctcgacggcgtcagcggacatgtatccctgccgctcgccacgtccgcatgctgctccttcttcaccactttataactgccgccggcactcatctcggactcggcgctctccgcggcggcttcctctcttgctctcttgcgagaagcatccgccggggccagcgacggttccgtcgacgtcggctcgtcgcggcccgcctcgagcgggaagttcaggatggccttgctcccgcggagcctgaacgcggcgcggtcgtaggccttcgctgcctccaccgccgtgtcgaacgtccccagccacacgcgcgtccccttgcgcgtcgggtcgcgtatctccgccgcgaacttcccccacggccgccggcgcacgcccc

SEQ ID NO: 1402 - DNA, 384 bp, Eucalyptus grandis
catgacccgacgccgccggcgaacgactgggtcatggagaccaggaagaaccactcggtgtcggcggcgtcgggttgcccggtcgggcctacttcagctcgaatcccgcgtgggtcacgggggccgagaggttggggaattgcgggtgccgatagggcccggcaggcgcagatcttcgggttgcagaccatcgcgtgcgtccctgttttgaacggtgtggtcgaactgggttccaccgagccgatctaccagagctccgatctgattagcggaattagggggctgttcaatttccatgaatcggagatgggatgcggtggtagggttttgaatagcgagcatgacccggcgtcgctttggatctgcgatccgccagtcacgatg

SEQ ID NO: 1403 - DNA, 380 bp, Eucalyptus grandis
ctctctctctctctctctctctctctctatctttgatacccaaacaaaacacacggaaaagaaaaacccacaagcacgccatggacaacaatgttgaggaataccagaactattgggagacgaccatgttctaccaaaatgaagagctcgacagttgggtggacgaggcgatatccgggtactacgactcgagctcccctgacggggcggcgtcgaccgctgcttccaagaacatcgtgtcggagaggaaccgaaggaagaagctcaacgagaggctattcgcattgagggcggtggtgcccaacattagcaagatggataaggcatccatcatcaaggatgcgattgactacatccaagagttgcacgatcaagagaga

SEQ ID NO: 1404 - DNA, 432 bp, Eucalyptus grandis
ccaacatcgttctcgagaaccccactccatcccagttcgacccatctgagaacaagtcaacccagatcgtcaaaatcgaatcttgactcgagggagaagcggagaatgacgaagcgcagcgcagccaaggccgcggcggtgcacgagggcgagggagcgaggagcgagctgaagttcagaggggtgcggaagaggaagtggggcaggtgggtctccgagatccgcctgcccaacagccgggagaggatctggctcggctcctacgacacccccgagaaggcggcccgcgccttcgacgccgccgccttctgcctcggccgccccgccgcgaagctcaacttccccggcagccccccggagatctccggctcggcgtccctctcccccgatgagatccagtcggccgcggcgagctacgccaacttcggggcc

SEQ ID NO: 1405 - DNA, 345 bp, Eucalyptus grandis
ccgacctcctctctccacgcggccactgtcccgtcgcgcgaattcgccccgccgtcgtaggagaccgcatcctccgccgccgcggcgatggccccagcttcattccctgcgctagcaacgcatttcaatggaagtatgctcaatgatactaactcatctggtgaaagtcacacacgtaatggaaggccacgaggagatgccaggggaaggaatcaattacttcctcgttactggcccaggataacagatcaagagctacaacaaatctcaggagactcgaactctgtaatcactcctctgtttgagaaaatgttgagtgctagtgatgcaggtaaaattggacgt

SEQ ID NO: 1406 - DNA, 471 bp, Eucalyptus grandis
actgggcaaaatattcctatctctactgcatatatagggctcgggagagagagagagagagagagactgcacagtatagtaatactaaataatacacctcctttagacttgactgaagatacaggcacaaccctagtaagagaagaaggagaaggggaagatgaaggtgagaaggaagctgagggagcccaggttctgcttccagacgaggagcgaggtggatgtgttggacgatggctacaaatggaggaagtacggccagaaagtggtcaagaacagcctccaccccagaagttattaccgttgcactcacagtaattgccgagtgaagaagagggtcgagcggttgtcggaagattgtcggatggtgataacgacctacgagggcagacataaccattccccgtgcgatgactcgaattcatccgaacatgaagggttcaactcgttctagtattgccccaagacaga

SEQ ID NO: 1407 - DNA, 471 bp, Eucalyptus grandis
agcaagcaaaagaggaaaccagataaaagcagacacctcggtttcacgttctctactacagaattccggagatggtgaagagagacagagaggacacggaggtcgaagccctggccctggccaactgcttgatgctcctctcccgagtcggcgagagcaccgactcgccatggctgaaccacaaatcccggcctacggagcggatgttcgcgtgcaagacgtgcaaccgcgagttttcatccttccaggcactcggagggcacagagccagccacaagaagccgaagctgtccggcgatctctttcacctagggcgctccgcggattcctcaccggccaagccgaagacgcacgagtgcgctatatgcggcctcgagttcccgcttggcaagcccttggcggtcacatgaggaggcacagggccgccatggcggagagcttggcgacggccgaaaagcctgtgccggtgtt

SEQ ID NO: 1408 - DNA, 303 bp, Eucalyptus grandis
gcgcccttctcgaatccatacgaggagctggcgaaccacttgctgctggacgatcccgaatcggacctttcggttcacttcccttccttcgcttccgatcccgaaccctgcaactccgctgtatctcctagttttagcgtggatggggatttcctttccgactatggcgacacctcggatcccacgttgaaatacataaatcagatgctcatggaggaggacatagatgacaaaccctgtatgtttcatgatcctttagctctcaagctgcagagaaatccttatacgatgctctctgtccga

SEQ ID NO: 1409 - DNA, 367 bp, Eucalyptus grandis
aatctcaggagactcaaactctgtaatcactcctctgtttgagaaaatgttgagtgctagtgatgcaggtaaaattggacgtttagtgctgccaagaaaatgtgccgaggcctattttccgcctatttcccagcctgaaggattgccgctcaaagttcaggatgccaaaggctcggagtggatatttcaatttcgattctggcccaataataacagtagaatgtatgttctggaaggagtcacgccgtgcatacagtccatgcagttgcaagcaggagacatagtgacatttagtcggttagaacccgagggaaaattggtcatgggattcagaaaggcttcaactgctccctcatctgatcaggaa

SEQ ID NO: 1410 - DNA, 353 bp, Eucalyptus grandis
cattaccaccaccaccaccaaaactctctctctacccttctctctctgcccttctctctctagaatttatggcgatgaaggagaaggcgggttcgggcggcggcgccaggctggcggtgagggaggcgcactaccggggggtgaggaagaggccgtgggggcggtacgcggcggagatcagggacccgaagaagaagagccgggtgtggctcggcaccttcgacaccgccgaggaggccgcccgcgcctacgactccgccgcccgcgactgccgcggctccaaggccaagaccaacttccccctcccctcggagcgccccgtcctcctcctcgccggagccgacggaggagca

SEQ ID NO: 1411 - DNA, 586 bp, Eucalyptus grandis
  misc_feature (1)...(586): n = A,T,C or G
atcaggtcccgcgccactccattcgcgnatctccgacctcctctctccacgcggccactgtcccgtcgcgcgaattcgccccgccgtcgtaggagaccgcatcctccgccgccgcggcgatggccccagcttcattccctgcgctagcaacgcatttcaatggaagtatgctcaatgatactaactcatctggtgaaagtcacacacgtaatggaaggccacgaggagatgccaggggaaggaatcaattacttcctcgttactggcccaggataacagatcaagagctacaacaaatctcaggagactcgaactctgtaatcactcctctgtttgagaaaatgttgagtgctagtgatgcaggtaaaattggacgtttagtgctgccaagaaaatgtgccgaggcctattttccgtctatttctcagcttgaaggattgccactcanagttcaggatgccaaaggctcggagtggatatttcaatttcgattctggcccaataataatagtagaatgtatgttctggaaggagtcacgccttgcatacagtccatgcagttgcaagcaggagacatagtgacatt

SEQ ID NO: 1412 - DNA, 427 bp, Eucalyptus grandis
gcttttccttacctaagatcgccagtagatcatcgctccatttcgctccttctcctccatcgtcttccggttggtgtttcgggaagccatggatcttgagtacccagaagagttcttgggcggtgcccacgaccaccattcgcagatctccaagggcaagcgcacgaagcgccagcggccggcctccccgagcggcggcggctgcgtcggcgccgacgccggcgtggccaccgggagggccggcttctacgtctacgagtgcaagacttgcagccgcgtgttcccgtcgtttcaagcgctaggagggcaccgtgccagccacaagaagcccaagtccacggccgatcctgaccagaaaatcaagccgtcgacggtggtcctgggcttggacgcaattgacgacgaagacgaggggcactccggtaaa

SEQ ID NO: 1413 - DNA, 375 bp, Eucalyptus grandis
gaaagtgacccactggctgccctgtgtaatctggaaatcgacaatgtgaattctctgttcgttttccatggctttggtgatgatgacatttgtggacacatatgcaaacttccagtaggggcagatctgatagagaacctgcatgttagtcagcaattctgagctcgtaggttcttcgcacttgagctttcggtaaattatgctcccggaaaatttcaatttcgccctaagcccttccaagaggtaagcaccaagacgctgaatcgggtcgcccataaccgacaccatttgctccagcatatccattagagctgctgcactagaagtatcggcatcagagattgcccttgccaggcgattaccacttgtttcaag

SEQ ID NO: 1414 - DNA, 369 bp, Eucalyptus grandis
ctcaaaatggacttgtgctgataacagttgggatccagaaagatcatcttgctcggcggatcaagacttgacggcagaagagcttgaagatatgctatctaataataatccagcaccttctaagaaagctaaggctcctaaacaagagaatatggaagcactggaggggctggatactcttgccaacctagcaatcttaggagaaggcgaggtgctcccatcatcttcttcatcatctcaagccacaacaaagcaccctcgacaccgaccagggtgttcatgtattgtttgtatacaaccccccagtggaaagggcccaaaacacaagccaacatgcacatgtaatgtctgtctgaccgtaaagcgcgt

SEQ ID NO: 1415 - DNA, 313 bp, Eucalyptus grandis; identical to SEQ ID NO: 120

SEQ ID NO: 1416 - DNA, 489 bp, Eucalyptus grandis
ctcttcgaaaaccctttctctctcttcgatctctctctctttctctctcctctgtgattgcagatcaggctcccacgccgttccattcgcgcatctccgacctcctctctccacgcggccactgtcccgtcgcgcgaattcaccccgccgtcgtaggagaccgcatcctacgccgccgcggcgatggcggcgccacgaggagatgccaggggaaggaatcaattacttcctcgttactggcccaggataacagatcaagagctacaacaaatctctggagactcaaactctgtaatcactcctctgtttgagaaaatgttgagtgctagtgatgcaggtaaaattggacgtttagtgctgccaagaaaatgtgccgaggcctattttccgcctatttcccagcctgaaggattgccgctcaaagttcaggatgccaaaggctcggagtggatatttcaatttcgattctggcccaataataacagtaga

SEQ ID NO: 1417 - DNA, 372 bp, Eucalyptus grandis
catcggcgagctccacggccactccggcatcgcgcggctcatgctcttctacgcccgcagcctcttcggcctcgtcgaccaccggaatggcatgggcgtcgcgaacgccggcctcgtgtacttcgacggccacctcctcgcgatgtccgaggacgacctcccctaccacgtgcgcgtcacgcgctccggcgacctcgagaccgtcggccgctacgacttcgccggccagctcgactctccgatgatcgcccacccgaagatcgacccggcttccggcgagatgttcgccctcagctacgacgtcgtccggaagccgtacctcaagtacttccgattctccaaggacggcgagaagtcccccgacgtcgagat

SEQ ID NO: 1418 - DNA, 354 bp, Eucalyptus grandis
gcggaatttgaatatcagaggagcacaaagcagccagcagtttgcgtggaggagaatgagttagctgacattttcgatagggttctactttgtgctccgacgggaaataagcctgattctaaatctcctggttctagatttgaggatgcctcaaataatggggcaagccagaatgtacagaaaaatcgcaatcacctgcactttcagccgaacagctctgtgtcaaaaaaccaatgagtgataagaaggaagtcgtggatctgaggaaccttctgtgttcttgtgcacaagcagttgccgtggaggatcgtaaaaatgctaatcaatatctgaagcagattaggcagcactcct

SEQ ID NO: 1419 - DNA, 540 bp, Eucalyptus grandis
ctcaatcggagttgggctggctgtgatatctgtgtccgcggccagggccgccatgctttttgccagcccgatggcgttgtaaatcgctgaaccgtaagaacggcagtaaacaagtgtcgcatgagtacggctttttgccgctgtgtgtcgccatgtgtttcttcaaattgcccttcaatgcaaatcgtttcccgcattgatcacattcgaacgggcgcaccttcgaactcgaatgagatgcgacatgacgcgttagtgcttcctcgaaatgaaaagactttccgcaaagtttacacgggaactcgcgcagcacatcgtactgtgtaggaacatattcgtctcctgaatcattgtccatcgctgtagaatcattttcttcttcttccgtagactcgttcgaattgttgttttccgttgaggtcgtcgcagattcaggagatccagcaggattggagataactggctcatccacaggcaacaacgcgatttcggcgagattttccatcaggatgggctccacagtgaccggagggccccctg

SEQ ID NO: 1420 - DNA, 349 bp, Eucalyptus grandis
gatgggttcaaacagtcttatgggcttggtgggaagagatcatcatcgattcggcctcccgaacaagagagaaagaaaggggttccttggaccgaggaagagcacaagctctttttgatgggtctaaaaaaatatgggaaaggtgattggagaaacatctccaggaacttcgtgatcacgagaacaccgacgcaagtagctagccacgcacagaaatacttcatcagacaactttcaggtggaaaagataagagaagggccagcatccacgatatcacaactgtgaatctcacagagactagaactccttcaccagatgataaaaggccgccttcgccagatccttcat

SEQ ID NO: 1421 - DNA, 378 bp, Eucalyptus grandis
  misc_feature (1)...(378): n = A,T,C or G
ccgaggccgacttcctggccaaacactccaagcccgagatcgtcgacatgctgcgcaagcacacgtaccgcgacgagctagagcagagcaagcggagctacaggggctccgccgcggaacgggccgggaggggcgggttcgggccggggcggacagagtggtcggccgccgcccgggagcagctgttcgagaaggccgtgacgccgagcgacgtggggaagctgaaccggctggtgatcccgaagcancacgcggagaagcacttcccgctgccgggcgggccggcggcgacgatgaagggcgtactgctcaacttcgaggacgtcggcgggaaggtgtggcggttccggtattcgtactggaacagcagccagagct

SEQ ID NO: 1422 - DNA, 358 bp, Eucalyptus grandis; identical to SEQ ID NO: 214

SEQ ID NO: 1423 - DNA, 373 bp, Eucalyptus grandis
catcctatgaagccggaatctgttgaagtactgaatttcggagatagtgggagcggaaggttgctttcgagtcattcacaggtcgcagttgcagaggagcctctgaaccacgtcgaggcggagaggcagaggagggagaagcttaatcagaggttttacgccctcagggccgtggttccaaatgtatcaaagatggataaggcttcactgctccaagatgcggagtcttatatcagggagcttaacatgaacctacaagctgcagagtctgataaggaggatttgaagaagcagttggatgaactaaagaagcgatcatcggataaagaatgtatcccggtggatcaagatcgcaagatggcaaaacctacgg

SEQ ID NO: 1424 - DNA, 425 bp, Eucalyptus grandis
  misc_feature (1)...(425): n = A,T,C or G
gcgaaccgagcgcgaatcggctaatgttcatcggaagcttctcataagaggaggggtccgaggcttcaattttcgagcagggctcatggatcgtcggttctacaccaaccccttcgtgcatgatcaagaagaagaccccgagcccgagcaaggccctgattcgccctcctcgggggaagactccaangtgaatgctatcgagccgtcncaaaagagaaggaagagcgtgaagaancgagtggtgtcggttccgatcgcgggcgaccccgagggatccaagagcaaaggggaggcctacccgccgtccgattcgtgggcgtggaggaagtacggccaaaagcccatcaagggctcgccttacccgaggggatactaccgatgcagtagctccaagggctgccccgccagaaagcaagtggagcgca

SEQ ID NO: 1425 - DNA, 434 bp, Eucalyptus grandis
gcactttcagcttcggcatcctgaaggccggcgagggaggtgatggtgtcgcggacgacgaactcggggtgacgaggcagctgttcccggtgagggaggtggatgcggatatggagtggtgcggcgagtcgtcctcgcttgataagaggagcgatgtcttcttggttggtgcttgtaaggaaaaggaaggtccgaggctggcgatgccgcagcagcggaggaagagcaggaggggaccgaggtcaaggagctcgcagtatagaggggttactttttataggaggactggaagatgggagtcgcacatatgggactgtggaaaacaagtgtatttgggtggattcgacactgcacatgctgcagctagacctatgatcgagctcaataaaattcaggggcttgatgcaacataaatttcaatttgagtgattatg

SEQ ID NO: 1426 - DNA, 414 bp, Eucalyptus grandis
gccagtatgaactctcctttagcccagcttgttaacccaagaaggatgcacacctacgagccatttgaccagttccccatgtggggagacaccttcaaagctgacaaggttaaaaatcttgaggcatcgtcatctgtgattgtgcatgcagtagatgatggattggacaagaagtttgaatatgtttctcatgaatcggcagaaaattccagctccaggagcgatcaagaagcaaatagacctgacaaggtacagagacgtctagcacagaaccgtgaagctgctcgaaaaagccgtctgcggaagaagaaatatgtacaacaactagaatcaagccgcttgaagctagcacagttggagctggaactcgggagagctaggcagcaagggttgctcttgggaaatggattcgac

SEQ ID NO: 1427 - DNA, 332 bp, Eucalyptus grandis
aaaagccctagctaaatcaattaacaagcgctaatcctaaaagcacaggcgaagatttcactgttctggagagagcttgatcttcaggggcgtcgagaagcgcggcttcttcgaggggtgggggctctccacctcgtcgtcgcccgacacgatgaacccggtcgggaactccggcagcgcgggcacgttcaggtcgaagttgcggcggccgctgtcgtatccgagcgcgggcggggccgcggaccccacgccctcggacgtggtgaccccgctgttggcggagccgctggcgccgccatcgtagtggcaacgcttgtgcccgcccagggcct

SEQ ID NO: 1428 - DNA, 318 bp, Eucalyptus grandis
gatccacccaactggccacagcagcaagcaaatcaacaatcaggagcaagcagtgagattcctcagcttccgctgccgccgccccctctgccagccggagggggcggtacaggctccatccggccaggttccatggccgatcgggctcggctggccaaggttccgcagcccgagcctggacttaagtgcccccgatgcgactcgacaaacaccaagttctgctacttcaacaactacagcctcacgcaaccgcgccacttctgcaagagttgccgccggtactggacccgaggaggtgcgtgaggaacgtgccagtcg

SEQ ID NO: 1429 - DNA, 349 bp, Eucalyptus grandis
gaaagcctaaagaaagcagatacaacaggaaaaggaggacaccaatacagatggttttacagaaagattcacaagaactaaaccgtcgctgatcttaggcacgagtcaagctgcttgagtggcgccatccttgcagttgtcgagatccgattcattgactgaagaaggcgccttgataaatgctgactgtcgagatgtttccccgagaaacttcaaagagagtggtgcaggttcattctcagcaagacttagctgagacattccaactatttggtcgatatttaggggttcttttggaattactgggattggctttagcacacggtgatgagatgtctccaccaccctt

SEQ ID NO: 1430 - DNA, 350 bp, Eucalyptus grandis
aacgcccgttctccacaacaagcgactctctctctttctctctctcctccaactaaaatcccaagcctcccaagtctctccgaccatggctccccgggagaggcccaacgccgtcaccgtcgccgtcagccccaggccccagggcggcgccaaggagatccgcttccgcggcgtcaggaagcggccgtggggccgctacgccgccgagatccgcgacccaggcaagaagacccgcgtctggctcggcaccttcgacaccgccgaggaggccgcccgcgcctacgacacggcggcgcgtgagttccgcggcgccaaggccaagaccaacttccccaccgccgacgagctcg

SEQ ID NO: 1431 - DNA, 350 bp, Eucalyptus grandis
aaccgacgacacaggtgacaagaatcacaggttcgaagggggtcaattgggtgttgcagcagcttctgattccagtgacagatcaaaagaaaaagccacagatcagaagactttacgcaggcttgctcaaaaccgtgaagctgccagaaagagtagattaaggaaaaaggcatatgtccaacaactggagagtagcaggctgaaactcacccaactagagcaagaactgcagcgagcccgtcagcagggcattttcatttcaggtagtggagaacaatcccactcaatgagcggaaatggtgccctggcctttgatgttgaatatgcacgttggcttgaagagcacaaca

SEQ ID NO: 1432 - DNA, 317 bp, Eucalyptus grandis
  misc_feature (1)...(317): n = A,T,C or G
cggggatacaggtgctggcaggtttaactacttaaatgataggtattattatcatcacaaaggtcgggttctggctgttaatggacatatgaatggtacttattatggcactggaagagggtcttccggtggaacatacagtactggttgtagtanaggctgtggtggcaggtcagactataagatcacgagaaaagatagggaatctatgcccaacatgagcgagcctcttgttgcctctttgtatgttcctaggaatgataagcttgtgaaaattgatggcaacttgataattcattctattatggcgagtgaga

SEQ ID NO: 1433 - DNA, 370 bp, Eucalyptus grandis
gctcaatgtagtcatcaagaaataaacatcctttagcaacgaaagccagaaagcctgaatctctaacggaaacttacatgcacgtgcatattaggccataaaaacatgacagataaaatacaaaatccctttttctaatgtgtaacatttttcggcagatttctaatgacattactcttcatcccaattttggtgcgcatcgcctccactcctgatcgattcatctctcttatcaccttcagcctgaccatttgttctcttgaccgtacagtggtagttaatcccatactcctgtaccttgaggccagtgcagcagtaattgccgcattatttccagttgatggacgaggtttctggcggtagtatctca

SEQ ID NO: 1434 - DNA, 210 bp, Eucalyptus grandis
gaaaagcgtacgcgaggaggcagcatgcgtggctcaccggagctaatgaggttgatagcaagactttttcgagagctattcttgcaaagagtgctcgtattcagaccgtggtttgcatccctcttctagacggcgtagtgcgatttggcaccacggaaagggttcaagaggacatttcactcgtcaatcatgtcaaaaccttcttcgttg

SEQ ID NO: 1435 - DNA, 557 bp, Eucalyptus grandis
ggtcgttcgacaacaccctgtcgctgctgagccgcgccgagcccgacgaggtgtcgcaggtgccggtcaggccctgcgccgtcaagtccgaggactccgaggagagcagcaagacctcggtccccagagaccgccgtggatgctacaagagaagaaagacttcggatacacagataaggatggatcataatttgattgacgacgggcaccagtggaggaaatatggccagaaagcgattcttaactcggagttcccaaggaactacttcaggtgtactcacaagatcgaccaaggttgtctagcgaccaaacaggtccaaaaggtacaggacgctccgcccctctataggaccatataccagggccaacacacctgcaagaacctcatcctgaaatccccctccctcatcctggactcgcccgagccctggggactcctccatcctcgtcagcttcaacaccagcctccctcccaagcaagacgacaacaacaacagcagcagcaaccccttctcctcttcgactttcccgtcggtgaagcacgagcccgaagctgc

SEQ ID NO: 1436 - DNA, 438 bp, Eucalyptus grandis
  misc_feature (1)...(438): n = A,T,C or G
aatcaacaccnctccccaatttctctctntaagatcccaccccaaccgccaccctcaatctctctctttctctctcttcttcagtgtctgccccgtctgcgacaagggcttcccctcctaccaggccctgggcggccacaaggccagccaccgcaagcacgcctcctccgccgcggccgccgccgggggtgacgaccagccgaccacctcgagcacctccgcggcgacgacctcctccggcgtctccgggaaggtccacgagtgctcgatctgccacaagagcttccccaccggccaggcgctcggcgggcacaagcggtgccactacgaggcccccgcccccatccccgcctccttctccgccccctccgccgccgccgccccggccgccagcggggtgagcgtgtcggagggcgtggggtccacgcacacgcagag

SEQ ID NO: 1437 - DNA, 327 bp, Eucalyptus grandis
tctctctctcttcgtttctcccgtttctctctctctacctctcgccaagaaaccgccaggaaaggaaggaaggtaaaaagaaaagaaaaggaagccatggctccgagagaaaagcccagcgtcgccgccatcccaaaccctaacggcgctaaggaaatccgtttccggggcgtccggaagaggccctggggccgctacgccgccgagatccgggaccccggcaagaagacccgggtgtggctcggcaccttcgacacagccgaggaggccgccgcgcctacgacaccgccgcccgcgagttccgcggcgccaaggccaagaccaact

SEQ ID NO: 1438 - DNA, 360 bp, Eucalyptus grandis
gcgagagctaaccgccaaaattacccagctctcatctttcccacttcaacaaaaataccggaccgaaagaatgtgtatacatatgtctatttgatagcataagaacgggtacataccgtgtcaaggacctccatgaacaaggatgaaaaactggctaatgcctggaaaactcctggcagacccgtttgaagattgttcaaggtacttgtcctcgtcacttccactgccttggaatgtttcagcatttcttcttctaccctcctttggcaggttgcaagttcaagtttcttctcggccagtgggtcccgagcatccagcacctggccattgtcgggcccaggatcagggaaccctacacca

SEQ ID NO: 1439 - DNA, 269 bp, Eucalyptus grandis
ccgaaacggaatcgttcttggggtttgaagcgaagccggtaattatcggtgaaacggcctcgaaaacctcgcaatcaagcaagaagccatcgctgaagatcgcggtgccgagaaaagtcgagctgctgcaattctccaaggcgaatccgatggttcaaggaggttcgaatcaagcacgcgacgagcagaggcactatagaggagtccggcggaggccttgggggaagttcgcggcggaaatccgagaccccaaccggaagggctcgcgc

SEQ ID NO: 1440 - DNA, 351 bp, Eucalyptus grandis
aagaagacgaagcagctcatccgaccatggtgttggtattgcgaacgagaatttgaagatgaaaaagttctcatgcaacaccaaaaggcaaaacatttcaaatgtggaatgtgtcctcgtcgtttgaatactgctggtggtttggctgttcatattcagcaagtgcacaaactcgaaccggaaaaccttccacgtatagaaaatgcactaccaggaagagatggctacgaagttgaaatctttggtatggtgggaatcccagcacctgatgtcgccgactacaaacgacgcaaggaaatcgaactgggactggcagcaggatccatttcacagcctcctgccaagcgtcag

SEQ ID NO: 1441 - DNA, 476 bp, Eucalyptus grandis
  misc_feature (1)...(476): n = A,T,C or G
gatagtccaagctctctgcctctctctctntctgtattctctatcttcatctgcggcgtcttgatcgctctcatctcgctctcgcgaatgttgtctctcgtcttctcctctgtccgccattcaaagatcacctattctttccgtttggtttgcggtgactaagaactctttctctctctcgctctgagtcactcttgctttctcccgacttttctgggattgatgaaaatggcggaaagatcgaacttgtcggacccggaaacaagccccttgaactcaccctccacctcctccgcttcttcctcgtactcacccgacccgcgccgccgggccggctcgcccgccgcggtccgcgacccgttgagatcctccaagcggagcaagcacccggtgtaccgcggggtccggatgaggaactggggcaagtgggtgtcggagatccgggagccccgcaagaagtcccgcatctggctcgg

SEQ ID NO: 1442 - DNA, 315 bp, Eucalyptus grandis
  misc_feature (1)...(315): n = A,T,C or G
gcaagnactttgaacctgggaatcatgtnaaggtcgtttctggtncccaagaaggtgctactggtatggttgtaaaggtggagcaacatgcgctgatcattttgtcagatacaacgaaggaactattaccgtttttgcagatgatgttgttgagagttcagaggtaacatntggaataaccagaattggagactatgagcttcacgaccttgtgctgctggataataccaacttcggtgtcataattcgtgttgaaagtgaagcttttcaggtaggtgacatgcactgaggcaagtctcttggacatgcccttca

SEQ ID NO: 1443 - DNA, 338 bp, Eucalyptus grandis
ctcagccgagcttcagagggaaaccgccatgccctcgcgaaagtcactctgccacacttatcgggaacgataagatggtcatttttgggggtagtggccaaggcgaagcgaactattgaacgacctgcatattctggacctagagacgatgaggtggatgtctcctgaggtaaaaggcgagattcctgtccctagggacagtcacagcgctgttgccatggaaaacaaattagtggtgtatggtggagattgtggcaatcggtatcttggcgatgttgatgtacttgatacggacacaatgacctggtcaaagttgactgttcaaggattttcacccg

SEQ ID NO: 1444 - DNA, 409 bp, Eucalyptus grandis
  misc_feature (1)...(409): n = A,T,C or G
gccaaggccacaaccatcaacaccaccaccagtttggccgtgatcattcttctccctcttcggtcgccatggctggtgcggcagggggtttagagagngagaacggcggaaatgggagatggcctatgcaggagactctcacgctcctcgagatcaggtccgaggctcgactctaggtttaaggaggccaaccaaaagggtcctctttgggacgaacttccggattatgtcggaagaacatgggtatcaacggagcggcaagaaatgcagggaaaaattcgagaacttgtacaagtattacaagaagacgaatgaacgaaaagcgggtaggcaagacggttagcactacaggttctttcgtcaagctcgaagctctctacggagagaacgccaatttgaattccatcct

SEQ ID NO: 1445 - DNA, 304 bp, Eucalyptus grandis
gaactgttgtacatggatggacaggctgacatcaagcagcgccaatcctccattaatgccttcaatgacccaacgagtgaagtgagggtgttgcttgcctctaccaaagcatgttccgaagggattagtctggtgggtgcttcaagggtcgtgttactagatgttgtgtggaatccgtcagttgacaggtaggccataagccgtgctacagacttggacagaagaatgcggtctatatttatcatctgatcacttctgggacaatggatgctgagaaatactgtcaacgggtgtaaaaggacac

SEQ ID NO: 1446 - DNA, 332 bp, Eucalyptus grandis
ggctccccgggagaggcccaacgccgtcaccgtcgccgtcagccccaggccccagggcggcgccaaggagatccgcttccgcggcgtcaggaagcggccgtggggccgctacgccgccgagatccgcgacccaggcaagaagacccgcgtctggctcggcaccttcgacaccgccgaggaggccgcccgcgcctacgacacggcggcgcgtgagttccgcggcgccaaggccaagaccaacttccccaccgccgacgagctcgtcgtcgccgtcgccgccgccgcccgcagccccagccagagcagcaccgtcgacaacgcctcccctccgc

SEQ ID NO: 1447 - DNA, 349 bp, Eucalyptus grandis
gtaaaacaacctccctcagctcctcttcaccactggtttttgagatgatctgtgtgctcggcgccgttgattattatgtcttattctgacttgctgaacctgctgtttgccgtgggcgtttggtgcaccgcgtatattgcggctgccgttctcgagtcgctccgggtcttccatactctctgttcgttttgatttcgatagctgttttcgaaggctaagatgggctacgcacagctggtcatcggccctgccggcagtggcaagtcgacttattgctcgagtttgtatcaacattgtgaagctattgggcggacaatacacattgttaacctagatcctgcagcagaga

SEQ ID NO: 1448 - DNA, 362 bp, Eucalyptus grandis
ccgcaacgaggcgataccatctccggcccgcgtcttgctcttccctctccaatcccatccatccctccatccatccatccatccgcccgaaccctccctttctctctccatctctctcgcgcagcatgattccgagccgagccgccgcggcgcccgacgacgtcccggaagtcgccggatcggcaccgaaggggcacgtacaacagcagcagcagccgcagcaacaggtcggcgccggcagcccaagtacaggggcgtgcggaggcggcggtggggcaagtacaccgccgagatcagcgaccccgtcaagaaggcacgcgtctggctcggcaccttcgcctccgccgaggagggcgccgcgc

SEQ ID NO: 1449 - DNA, 281 bp, Eucalyptus grandis
  misc_feature (1)...(281): n = A,T,C or G
cagcagaccagaccattccattccattccatttcgcattctctactacagactcgcagagatggtgaagagagacagagaggcgcggaggtcgaagccctggccgnggccaactgcttgatgctcctcccccgagtcggcgagtgcgccgactcgaaccgcgaatcgcggtctacagagcggatgttcgcgtgcaaagacgtgcaaccgcgagttcttctcattccaggcgctcggagggcatagaaccagccacaagaagcagaagctgatccccggcgg

SEQ ID NO: 1450 - DNA, 389 bp, Eucalyptus grandis
aagaagacgaagcagctcatccgaccatggtgttggtattgcgaacgagaatttgaagatgaaaaagttctcatgcaacaccaaaggcaaaacatttcaaatgtggaatgtgtcctcgtcgtttgaatactgctggtggtttggctgttcatattcagcaagtgcacaaactcgaaccggaaaaccttccacgtatagaaaatgcactaccaggaagagatggctacgaagttgaaatctttggtatggtgggaatcccagcacctgatgtcgccgactacaaacgacgcaaggaaatcgaactgggactggcagcaggatccatttcacagcctcctgccaagcgtcagaaaatggatcaccggccgatatctcagagcgaattgaag

SEQ ID NO: 1451 - DNA, 381 bp, Eucalyptus grandis
gctgcgctgccccttcccttttgaccgttgctcctcccccttctctctctaccaacgtctctctctctctctctctatctgcactgtgattccctcaccttctcgcagcctcgccatcttccctcctcccaactcctcgctccttcgctcgctcgctacagtccagatatttcgcgatcaatctcgaacagcttacggagatccttatgtatctggtgataagcataagagaacacccttgtgaattccgtttcgatttgcattttaaaagttcatagtgtgaagagagttggaaatctgaggtgcaagatggggtgttcctcatcaaagcttgacgatgaagaggcggtcaagctatgtaaggatcggaagcgattcatt

SEQ ID NO: 1452 - DNA, 381 bp, Eucalyptus grandis
ggcgagctctcttatcttcttcttcctcctgctccacctaaaaccctcgcccggcaaaaccgattcgaggtcgagagtcgagtaaagatgaatgtggagaagcttatgaagatggcgggttcagtccgcactggtggaaagggtaccatgagaagaaagaagaaggctgtgcacaagacaactaccacggatgacaaaaggctccaaagcactctcaaaagaattggggttaatgctattcctgcaattgaggaagtcaacattttcaaggatgatgttgtcatccaatttgtaaatcccaaagttcaagcctctattgcagccaatacatgggttgtcagtggtgctcctcagaccaagaaattgcaagatatcctccca

SEQ ID NO: 1453 - DNA, 378 bp, Eucalyptus grandis
ttttttttttttttttacgcaatggaagaacaaactgttttccaactgaaagtacaaataactcctaatctagaattaggtaaatgcttaaatcctgctacctacaaatgtgaaccacgatgacaaggttcccaacaccaaatgtttggtacgatgtgaaaacttgacgacctgacagcaattagcatataccaacctaacgaaactacgagggggagagagcttatgggcacggcaccagctatatcaagtacgcactctcttattgctgcaggagggacacttgtactgcttgatgtgctcagccctggcgggagtaattttcacgcatttcccatggaaccacttctcgcacatgtcacaacagatccagaactc

SEQ ID NO: 1454 - DNA, 339 bp, Eucalyptus grandis
atgctgctgccacgaacagccgctttacaatcttttacaatccaagggccagtccatcggagtttgtcatacctctggcaaaatatgtgaaagcagtctatcacacaagggtatctgttggcatgcgattcagaatgctttttgagacagaagagtcaagcgttcgtagatacatggggacgataacaggcattagtgatctggatcctgttcgctggcaaaactcacattggcgttcagtaaaggttggatgggatgagtcaactgcaggtgagaggcagccaagagtatccttgtgggaaattgagccactaacaacattcccaatgtatccttctc

SEQ ID NO: 1455 - DNA, 372 bp, Eucalyptus grandis
gtcggtgttaggagattaatgagacagcaaagtaacatgccatcctctgttatatctagtcacagcatgcatcttggggttctggccactgcatctcatgccattgcaactggaactctcttttctgtattctacaaaccaagaacaagtaggtcagagttcattgtgagtctcaataaataccttgaagcacgggcccacaagctatccattggaatgaggtttaaaatgaaatttgagggtgaagaagtttcagaaagaaggttcagcggcacaatcattggtgtaggagacagcatgtcatctggatggactaattctgaatggagatccttaaaggtccaatgggacgaaccttcatcaatcatttgg

SEQ ID NO: 1456 - DNA, 436 bp, Eucalyptus grandis
gcaacgtagtgtttccatagcaactcaaacaacaaaggaacttgttttaaaggattatgctctggagtcagatgagacaagaatatacaaagcagcgcgaaaaatggttgccagccttgctggaagtctagctcatgtgacatgcaaggaacctttgcgtgcttcaatatcaaatcagctaaaaaattcgcttcagggcttgaatctatctgctgaacttctagaccaggctgttcaactggctaccaatgataatcttgaccttggctgtgcagtcattgaacgggctgcagctgataaggcaattcaaaccatcgatggtgaaatatctcaacaacttaacctaaagaaacatagggagggtgttgctccagcattttttgaagccactgtatttggtcaaggttcaatgggcattctcccagaggctcttcgc

SEQ ID NO: 1457 - DNA, 352 bp, Eucalyptus grandis
gcgcggcggaccgggggggagctggaaatgaagtgcccgtactgctcggcgtcgtcgcaggggcggtgcgccaccgccggcggcggccgctcgatcaccgagtgcacctcctgcggccgcgtcgtggaggagcgccaccacttcccctccctccccccccaagccctagccctcgccgacgccgacgccgaccccttcgagtccaccggcttcatcaccgccttctccacctggtccctcgagcactccccgctctccctccgctcctgcctctccttctccggccacctcgccgagctcgagcggaccctcgagtccaccaacccctcctcctcctcctcctcctcgtcga

SEQ ID NO: 1458 - DNA, 364 bp, Eucalyptus grandis
  misc_feature (1)...(364): n = A,T,C or G
gagaaatttaagatcccggtggagttcaacggtttgccggagtttgccccanatgttactcgtgacatgcttgatgtcaggccgggggaagctctcgcagtgaacttcccactccagctacaccacacgccagacgagagtgttgacatcaccaatccaagggatgggctactaaggatggtgaaatcgctttctccgaaagtgatcacattgatcgagcaggagtcgaacacgaacactacaccgttcctgacaaggtttgtggagaccctcgactactacttggcaatgtttgagtccattgacgtgaccctgcccagagacaggaaggagaggataaacgtggagcagcactgtttggcaa

SEQ ID NO: 1459 - DNA, 224 bp, Eucalyptus grandis; identical to SEQ ID NO: 293

SEQ ID NO: 1460 - DNA, 363 bp, Eucalyptus grandis
gggaaaggccctcgaaaatgggttcggttcggcgtcaggcgagctcaggatccgatggcgacccgaggctcggtggggtggccgatgatgaaaggaagaggaagaggatggagtccaacagggaatccgccaggcgctcccggatgaggaggcagaagcagctgggggatttggtcggagaagtggggcaactgcagcaggctaacgctcagctcgcggtgagtatcaatgctgctgcgcagaagtatgccgaggtcgagttggcaaacaatgtcctcagggcccaggccatggagcttaccgagaggctccggtccctgaactcggtactcgagatcgtgaggtggtcagtgggctggtgat

SEQ ID NO: 1461 - DNA, 351 bp, Eucalyptus grandis
gtttgcccaaccatggtccactccctacttcaggagaaaatatcttaatgtctgagcttgcagagtgctgcaaggaattggaagaagggcaccgtgcttgggctgcacacaagaaggaagcggcatggaggttgaaacgactggagttgcagttggagtcggagaaggcgtgcaggaggagggagaaaatggaagagatagaggcgaaaatcaacactctcagggaagagcagaaagcttctttggataagattgaaacagaatacagagagcagctggcaggattgaggaaagatgcagaatccaaggagcagaagctggctgaacagtggacggcgaagcatgtcagct

SEQ ID NO: 1462 - DNA, 209 bp, Eucalyptus grandis; identical to SEQ ID NO: 292

SEQ ID NO: 1463 - DNA, 423 bp, Eucalyptus grandis
ctttggctttccttctccatctctctcgctctctctttgggattcgtgtgttctttcttcttttttgcaccacccgagattttccgaaagctgaagtggccggggagtgaagtttaagagagagagagccatcaccaaaagcccgaagatcatggggagaggaaagatcgagatcaagaggatcgagaacacgacgaaccgtcaggtcaccttctgcaagagaaggaacggactgttgaagaaggcctacgagctctccgtcctctgtgatgccgaagtggccctcatcgtcttctccagcagaggacgcctctacgagtactccaacaacagcataaggtcaactatagagaggtacaaaaaggctaattcagatagttcaaacacaagcactgtcacagagatcaatgcccagtattatca

SEQ ID NO: 1464 - DNA, 379 bp, Eucalyptus grandis; identical to SEQ ID NO: 98

SEQ ID NO: 1465 - DNA, 334 bp, Eucalyptus grandis
catcacacaggttgatttgagaactgaaatcaagatcgtcgtcgtcgtcgtcgttctcgtcggtgctgctcggccgcatttgactcggcgtaacgaacgaagccggttgcgatctagggttgttggggggcgcggaggaagctcgagcctcggtcgtttgttttctttttcttttttgccgatcatggaaggcgtcggcgtcgatcacctggccgatgagcggcagaaggcgcggttcgacgtggaggagatgaaggtcgtctgggccggctctagccacgccgtcgaggtctccgatcgcatggcccgctcgtcgccagcgatccggcctttc

SEQ ID NO: 1466 - DNA, 371 bp, Eucalyptus grandis
tctctctcttcgaaaaccctttctctctctctctctctcctctgtgattgcagatcaggctctcgcgccactccattcgcgcatctccgacctcctctctccacgcggccactgtcccgtcgcgcgaattcgccccgccgtcgtaggagaccgcatcctccgccgccgcggcgatggcggcgctggcccgagctccattccctacgctagcaacgcatttctttggaagtcaggccaggggaaggaatcaattactccctcgttactggcccaggataacagatcaagagctacaacagatccctggagactcaaactctgtaatcactccgctgtttgagaaaatgttgagtgctagtgatgcaggtaaa

SEQ ID NO: 1467 - DNA, 456 bp, Eucalyptus grandis
ggttgccgagttgtgtggagtgccatttgagttccacgctgccgccatgtgtggaagtcaggttgaacgagaggacctcagagtgcgacctggcgaagctatagccgtgaattttccctttgttttgcatcacatgccagatgaaagcgtcagtaccgataatcaccgcgatcggctgctgcgattggttaagagtctatccccaaaggtggtcaccctcgtggagcaagagtctaaaaccaacacgtccccattctatacaaggttcatagagactttggactattataccgcaatgtttgagtcaattgatgtagcgtgccgacgggatgacaagcaaaggatcagtgcggagcagcattgtgtcgccagggacatagtcaacatgatagcttgtgaggagacggaaagggttgaaaggcatgaacttttggggaaatggaggtcaaggtttag

SEQ ID NO: 1468 - DNA, 417 bp, Eucalyptus grandis; identical to SEQ ID NO: 326

SEQ ID NO: 1469 - DNA, 460 bp, Eucalyptus grandis; identical to SEQ ID NO: 100

SEQ ID NO: 1470 - DNA, 408 bp, Eucalyptus grandis
gaggaagccgtcgccgtcgagccgagtcaggaggtcttcgatcgcttcttcgccggcttgctcgttgattcccccgagggcggaccggccgaggcgaccgacggcgcgagcgacaaggagtccaattcatccgacggcggcggcggcggcggcggcgaacgggatgagaagctggtcgtcggagataacgagctttccgaggacgctgatgatgatgatcccgtctctaagaaacagagaaggcagctcaggaataaggatgcggcggctaggtcgagggagaggaagagaagttacgtgaaagagctggagatgaagagcaaatatatggaaggggaatgccgcaggctggggcggttgctccagtgctttgtggctgagaatcaactctgcgtctgaatttggaga

SEQ ID NO: 1471 - DNA, 530 bp, Eucalyptus grandis
gcagaatctgtagtatatatgacgatgaaagggaaatctatcactgcccttactgtaacttgtgtcgtgtgggaaagggattgggcattgactatttccattgcatgaactgcaatgcctgcatgtcgcgctccctttcagttcacaaatgcagacagaaatgcttagaagataactgtcctatttgccgtgagtacatttttacatcgaactctccagtaaaggccctcccctgtggccacttgatgcactcggcatgtttccaggagtatacttgtactcactatacttgtccgatttgtagcaagtcactaggggacatgcaggtttattttaaaatgttggatacacttttggccgaagagcaaatgccagatgagtattctggcaagacccaggttattctctgcaatgactgcgagaagagaggaagcacatcttttcattggttttatcacaagtgccgtcattgcggttcatataacacgaggctgctttgattccaacctaagacgcatatatataactct

SEQ ID NO: 1472 - DNA, 381 bp, Eucalyptus grandis; identical to SEQ ID NO: 102

SEQ ID NO: 1473 - DNA, 567 bp, Eucalyptus grandis
  misc_feature (1)...(567): n = A,T,C or G
cacggcaacaaatggaagacaagacgctgttcttcctcactgagggatcccttctttatacctggtttcaggtagttcttccacctctctaagcaggacttggcatcacggttaaggggagtgttcatgcgctgagacacaaggtgccactcccttgggccatactgtttcacatatgcacgtaacaaggcgtcctcttcagctctccaacgctgtctttccttcattgccaggtgtagacaccacttcccattgcctcaaacttagatctttcatagtgtggctacagaagaagatggtgataatacaaattagaagtaatttctcacatcacaatataatacacgacattttagctgagttaactggtctgagaaaagaaaagaatcccaaggaggagacaggtttatccaaggaaatgcccggcttncatggcttctgcggtccatacgggatggccatcgacggtggtcatagcggaaatgctaacagtttcatggagaattgccagagattgaacatgctcgttccatacgatcagggccatgatcaggagcagatcaacgc

SEQ ID NO: 1474 - DNA, 423 bp, Eucalyptus grandis
tcccgctccattcacagatcagcggcacttcttgcgcagacaattgcagactctctctctcattcaggcgcctgtcttctcaagaattttgtcaaagaaactcctttgttttttctctctctctctctctctctcgaccatggcccgaccgcagcagcgatatcgcggcgtgcgccagaggcattggggctcctgggtctccgaaattcgccacccgttattgaaaacaagaatttggctagggacgtttgaaacggccgaggatgcggctcgagcctatgacgaggcggcaaggctaatgtgcgggccgagggctcggaccaacttcccttacaacccaaacatgtctcagtcttcttcgtcgaagctcctctcggcgacattgacagcaaagctccacaggtgctacatggcctcgttgca

SEQ ID NO: 1475 - DNA, 402 bp, Eucalyptus grandis
  misc_feature (1)...(402): n = A,T,C or G
ccaatcttcactccccctatcccctctctctctctctcaagaactaagagcttactatggaaagcgaacgctacgatgagacgacagagaagcagcgaatcaggagaaggccgcaccagaagccgtacaggggtatccggatgaggaagtggggtaagtgggtggctgagatcagggagcccaacaagcgctcccgtatctggctcggctcctacgccaccgccgtggctgccgcccgcncctacgacaccgctgtgttctacctccgtggcccctctgcccgcctcaacttccccgacctcatcttgcacgagggccaggactcgctgggtgaggtctcagccgcctccatccgcaggcgtgcagctgaggtcggggcccaagtttgatgcttgtccaagc

SEQ ID NO: 1476 - DNA, 269 bp, Eucalyptus grandis
  misc_feature (1)...(269): n = A,T,C or G
gaggagatggcgagggggaagatccagatcaagctgatagagaacacgacgaaccggcaggtgacctactcgaagcgacggaacgggctnttcaagaaggcgaacgagctcaccgtcctntgcgacgccaaggtctccatcatcatgatctccagcaccggcaagctccacgagtacatcaagctcctccacctcaacgaagaagatgtacgatcagtatcagcaggcgctcgaggttgatctctggagctctcactatgagaagatgc

SEQ ID NO: 1477 - DNA, 297 bp, Eucalyptus grandis
ggcaaccagtgtgagatgctcctgctgtcacactgtcaaccttgcaccagttacacctgcttccaatcaatatgctcatgtaaattgcggaaactgtcggacgatgctgatgtatccatctggagctccatctgtgaagtgtgcgatctgtcaatttattactaacgttggtgcgggcaatccaagggtttctgttccaccacaaagaatcgatggaccaccgtcagggacaacaccgtctacttcaacgtcaatgccccaatctactcaaactgtagtggttgaaaaccccatgtc

SEQ ID NO: 1478 - DNA, 408 bp, Eucalyptus grandis
ggctgtctctacaacttcaaatgcaattattggcctcagagacagtagacttgtcccgcagcttgttgaactctgccatgggttcatgtacatgtggaggtcaatgaatgaataccatgagattcagaacaacattgtgcagcaagtccggggccttgtgaaccgagcaaacaagggtgaatctacttctgaattgcatcggcaggcaactcgtgacctcgaatcagctgtttcttcatggcattccagtttctgccgcttaattaagttccagtgtgatttcatccgttcccttcacggctggttcaaactgactctccttcctgttgacaatgataacaatgggacccaggaacactctgatgcctatgccttctgcgatgagtggaagcttgcactaaacatgtc

SEQ ID NO: 1479 - DNA, 317 bp, Eucalyptus grandis
attatatcgtcgtgtctatttcccgaaatatttgcataactactagctgggtcctgtcgtaagccttacaataaatctactattagctgagtattgggtgtcgaataatttgcacgaagccacgaactattggcaatcgatctcatggcttcctcgagcggaacgtcttccgggtcaaccttgatccagaactcgggatcagaggagagtctgcaggccttgatggatcagaggaagaggaagaggatgatctccaaccgcgagtcggcgaggcggtcgcggatgaggaagcagaggcacctggacgatctgatgct

SEQ ID NO: 1480 - DNA, 411 bp, Eucalyptus grandis
  misc_feature (1)...(411): n = A,T,C or G
tgtcattccattgaacactttgccatggaagtgcaagaagatgatgaccaggtttcaccagaaacggtgaaccccaaaacaccctctattgaggaagaatctgctaaaacgaaagcttctggcatcgatcaagaacagggcgattcgtcgaactcgcaggagaagccccccctgaagaagccggacaagatcataccttgcccgcgatgcaacagcatggacaccaagttctgctactacaacaactacaacgtcaatcagccccggcacttctgcaaggcctgccaaagatactggacggccggcggtaccatgcggaacgttcccgtgggagctgggcgccgcaagagcaagagctcagcttcgcattatcgccagatcactctctctgangctcttcaagcaagctcg

SEQ ID NO: 1481 - DNA, 401 bp, Eucalyptus grandis
gtccgtggagccatcgaacgtcccagagccacgggaaaattggctgcgcctgtaaactcgcccagcatgtcctcatcattggacctgaagaattcttgcatggatgcaaatgccaaccctgtgagcattttgcaacctggtgtagtgccacctgaagcctggttacagaatgaaagagaactgaaaagggagaggaggaaacagtcgaaccgtgaatctgctagaagatcaagactgaggaagcaggctgagactgaagaacttgccaaaaaggtggattctctgagtgccgagaatagggctcttaaatctgaaattagtcaactaaccgagaactcggataaattgaggctagaaaatgccacattgatggaaagactggaaaatgcacagggagtgga

SEQ ID NO: 1482 - DNA, 438 bp, Eucalyptus grandis; identical to SEQ ID NO: 286

SEQ ID NO: 1483 - DNA, 370 bp, Eucalyptus grandis
  misc_feature (1)...(370): n = A,T,C or G
cagtcgggtttgccgttagatgataggcccgagggagctcgctccccttctccggaacctatatatgataatatggggattaggatcaatacgagagagtatcgtgctcgtgagcgtctgaacaaggagagacaggacattattacacagattattaagcggaatccagcgtttaagcccccggctgattataggcctcccaagctacagaagaagctgtacataccgatgaaagagtaccccggttacaattttattggacttataataggacctaggggcaatacccanaaaaggatggaacgtgaaactggtgcaaagatcgtcattcgnggaaaaggttcagtgaaagagggtaggttgcagcaga

SEQ ID NO: 1484 - DNA, 335 bp, Eucalyptus grandis
  misc_feature (1)...(335): n = A,T,C or G
gaggaggagagcaggaagaagggcggcggcggtagcggcgagtcaaaccagggagggaaaggctcgaggtcggatcaggagagaaggaaggggattgcttggaccgaggaagaacacaggtggggtcttcttcttgtcaatcggttatttcttctaggcctagataaatatgggaaaggcgattggcgaagtatttcccggaactttgtcgncacaaggacgcctacgcaagttgcgagccatgcacagaagtattttatccgtctgagctctgttaacaaagataggaggcgatctagcattcatgatatcactaccgtaggcagtggagacct

SEQ ID NO: 1485 - DNA, 371 bp, Eucalyptus grandis
gtggttttgccgtcctcggggatggtgaaatcgagcggaggcgcgggggattctgatcattcagatcttgaagcgtccgtcgtgaaggaagctgatagtagcagagtcgttgagccggagaaaaggccgcgaaagcgaggtaggaaacctgccaatggccgagaggagccattgaatcatgttgaggccgagaggcagaggagggagaagcttaaccagcggttttacgcgctccgggccgtggttcctaatgtttccaagatggacaaagcgtcacttcttggcgatgcgatagcgtacatcaaggagctgaactcgaagctccagaccacggaatctgacaaggagaatctgcagaagcaaatggaatc

SEQ ID NO: 1486 - DNA, 373 bp, Eucalyptus grandis
accaccaccagtaccaccacctccctctctctctctctctctctctctccttttccctctgttcgtgttcggtacgattgcgaagcggaaagcgaatgctcctctccggattgccatgaactccaacgcttcctccaacccccagtcgatggccacctccacgacgtcggcgaccactccggcggcgggcggcgacggcggcaagaaggtcaggaagccctacacgatcaccaagtccagggagagctggaccgaggaggagcacgacaagttcctcgaggccctccagctgtttgaccgcgattggaagaaaattgaggattttgtgggctcaaagactgtcattcagatccgaagccatgcccagaaatac

SEQ ID NO: 1487 - DNA, 319 bp, Eucalyptus grandis
gagatggtagttaatacgagcctcggagagcagctcgacggatgatgatgatttgtacaagaaaccaagggaagaaacaataaaggcgaagatcacgagggtttattataggaccgaagggccaggcactagccttattgtgaaagatggacaccagtggaggaagtatggacaaaagatcaccagggacaacccttgtcccagagcttacttcaaatgcgctcacgctccaagctgccttgtcaagaagaaggtgcaaagaagtgctgaagaccaatcggtcatagttgcgacttatgaaggcgagcacaaccatcca

SEQ ID NO: 1488 - DNA, 384 bp, Eucalyptus grandis; identical to SEQ ID NO: 35

SEQ ID NO: 1489 - DNA, 411 bp, Eucalyptus grandis
aagagttgccgcctccggtggatcaactacttgcggcccgacctcaagaggggcgctttctccccacaagaggaggagctgatcatccacttgcattccatccttggcaacaggtggtcgcaaatcgcggctcggttgccgggacggactgacaacgaaataaagaacttttggaactcaaccataaagaagaggctcaagaactcgtcatcatcttcttgtagacactcgccaaacacgagcgattcctccttgtcatcagacgttaaagatgtcatgggaggtctcatctcccttcaggaacaaggactcatgccactttatatggactcgttgtcgtccgtgcaagctttggctcttaaccaggttatcgatccattactaccctcactcaaccaaaggcctcgacct

SEQ ID NO: 1490 - DNA, 396 bp, Eucalyptus grandis; identical to SEQ ID NO: 97

SEQ ID NO: 1491 - DNA, 188 bp, Eucalyptus grandis
tggatgttacttattgttcaattggatttgactccaggtaacccatggacggaggaagagcatcgaaggtttttaattggtctccagaaattgggtaaaggagactggcgagggatagctcgtgactttgtgactacaaggactcctactcaagtggcaagccatgcccagaagtattatatccggca

SEQ ID NO: 1492 - DNA, 461 bp, Eucalyptus grandis
caccggaaacagtccatgttcagaattattctccaattcatcaaatgggcattgatggattctttccagcgcatccctccccacagaatccttcgtaccattcttactcccccaacaatagacccaatttccctcctccgtcccctcaaacttcacagtgggactatttttggaaccccttttcatccctggactactatggataccccactcggagtagtattgatcatatggctatggatgatgagaccagaggattgaggcaggtccgagaggaagaggggattccagacttggaagaagaaactgagcacgaagaatgtgatcaccactcgtatgttgatgaagatagaggcaacagagatgctaatttccccactgaggaagttttagtggaagatgttgatgacaggaagaggatgaggatgaaggaacagacacagctgtgaatctgaggatga

SEQ ID NO: 1493 - DNA, 445 bp, Eucalyptus grandis
gtttcgaagaagggcgagccaataagcaatcggcatcatatacagaagatggtgagctttctgaaatgcttgataaggtattgctcggctgcggtttagggggtcaaatgtcggggtgcacacccgagaacatgagccaatccaagggcccacctggtccaaagggtggcagggttcgccgtaagaagggaaataagagcacagcagacttgaggagtcttctgattctctgcgcccaagctgtctctgctaatgacttcaggacagcttatgaactgctaaagcaaattagacaagattcttctgcctctggtgatggctctcaaagattggcgcattactttgccaatgggctggaagcacgccttgcaggcagtgccggtgatagacaaacctttttctattcttccgaattgcagaagaggacagtagctgataaagttga

SEQ ID NO: 1494 - DNA, 419 bp, Eucalyptus grandis
cggaaccggtggcaattggatcgctcttcctcgcaaagccgggcttaagcgctgcggcaagagttgcaggctaaggtggctgaattacctgaggccagacataaagcatggaggtttcactgaggaggaggatcacgtcatctgcactcttttctttaccataggaagcaggtggtcggtaattgcttccaaattgccaggaaggacagataatgatgtgaagaactactggaacaccaagctgaagaagaagctaatgaagcaactggcttctctgaaaacagtgcctgaaagtaactttgactatcaggtctgcgcacagaactcggcctcaatcgatcctgagaccaagaatcgggaatatgctgctaattcaatgggattccccaagcagaacttcaatccaggaatacccactt

SEQ ID NO: 1495 - DNA, 388 bp, Eucalyptus grandis
ccaatggtgacagtgttaaggatgaccttgatacagatgaatatgaaactcatgccacagttttggataagctattagcatgggagaaaaagctctacgaagaagtgaagcaaggtgagcacatgaagctagagtatcagaaaaaggtggctttgctaaacaagcagaagaaacgtggtgctagtggtgaatccctggagaaaacaaaagcagctgtaagtcatttgcatacgacatacatagttgacatgcagtccatggattcaactgcttcagaaataaaccacataagggacaaacagctgtacccaaagcttgcgcaacttgtcgatgggatggcgaatatgtgggaaaaaatgcgcatgcatcatgataagcaggagtctat

SEQ ID NO: 1496 - DNA, 417 bp, Eucalyptus grandis
  misc_feature (1)...(417): n = A,T,C or G
ctccctcctcctccaaacgtttccgtttctctccaagctgaacatggacaagaagccagacgacgacagtggtaagtcccaagatgtcgaggtgagaaaagggccgtggacgatggaagaggatctcatcctcatcaactacatagcgaatcacggcgaaggcagttggaactccctagccaaagctgctggtctaaaacgtaccgggaagagttgtcggctccggtggctgaactatctgcgacccgacgtccggagaggcaacatcactactgaggagcagctcctgatcatggaactgcatgccaagtggggaaacaggtgagatgcacataagtcacacaacttttcgttacataggttctacaacataatacccatcgatcatattgaaacaaggtccccgtggnatcacga

SEQ ID NO: 1497 - DNA, 404 bp, Eucalyptus grandis
catggacatgctgaagaggacaagaagctcatcaacttcatcctcacccatggccaatgctgttggcgggctgttcccaagcttgctggactgctgcggtgtggaaagagttgcaggctgaggtggaccaattacctgaggccagacttgaagagaggccttttgtccgagtatgaagagaaaatggtcattgacctccatgcgcaacttggcaacagatggtcgaaaatagcctctcacctcccgggaagaacagacaatgagatcaagaatcactggaacactcacatcaagaagaagctcaagaagatgggcattgatcctctcactcacaagccattagtcaccaacaacgacaacacaaccgatcaacaacccccccaagcagcccagacccatcccca

SEQ ID NO: 1498 - DNA, 340 bp, Eucalyptus grandis
gtcagaggcaatcccaatccaaggagttactacaagtgcacaaatgctggatgccctgtgaggaagcatgtggagagggcctctcatgatccaaaagctgttattactacttatgagggaaaacacaatcatgatgttcccactgcaaaatctagcagccatgacactgcagctccctccgctctaagtggactgccaagaacaagatcagaaggtgaaacagtgagcctagatcttggtgtgggaagaagtgcggcatcagaaatggcgtcagctgagaagcagcagatcctccggccaaaccctgtccaaagtcgaatccactatgccagttccgctt

SEQ ID NO: 1499 - DNA, 311 bp, Eucalyptus grandis; identical to SEQ ID NO: 281

SEQ ID NO: 1500 - DNA, 324 bp, Eucalyptus grandis
gttgaatggggattcaaacaatggcttcacaaggcggcggcggcagcagcggtaatgccagaggtggcggtggcaataatggaaaatccactgaagttcagccattgactcggcagaattcaatatacagtctcactcttgatgaggttcaaaaccagttaggtgatttagggaagccattgagcagcatgaacctggacgagcttttgaagaatgtctggacagctgaggccggtcagtcaatgtttatggatgttgagggcacggctgtggctaatcaaaatgctctcccccgtcagggaagcgtttcattaactggtgcat

SEQ ID NO: 1501 - DNA, 380 bp, Eucalyptus grandis
ctctctccctctccctctccctctccctctccttctccctccctctcttcgatgacacggggctagataagtttagggtttcttgagttcttgctctctctctctctctccctgtagagattttttattggagctttttttttttttttggttcctggtgttcttgtcgttggtcatagcaagaaaagagagatggggagagggagggttcagctgaagaggatcgagaacaagatcagtaggcaagtgactttctcgaagcgacggactgggttgctcaagaaagcccacgagatctccgttttgtgcgacgccgacgtcgctctcatcgtcttctccaccaagggaagcttttcgagttttcgactgactcttgcatg

SEQ ID NO: 1502 - DNA, 347 bp, Eucalyptus grandis
gaactacctctgagagtcgacgactcagaggatatgttggtatatggcgctttgtgcgatgcactcagttctgggtgggcgacgccttcggcttcgaatcaagaacttgatttcgaaacgaggactgttgataacgacggcattggtctggagctgcagacgagaccggagatggtgaagcgcgagatgagagcgccagtcaggacggtgcattacagaggagtgaggaggcggccatggggaaaatatgcagcagagataagagaccccaagaagaacggcgcgaggatttggctcgggacttacgagctgcctgaggacgcggcattggcctatgaccggccgct

SEQ ID NO: 1503 - DNA, 312 bp, Eucalyptus grandis
  misc_feature (1)...(312): n = A,T,C or G
ggtttgctcagatgcagcaagagctgcaggctcagatggactaattacctccgtcccggtatcaagcgcggtagcttcacggaccaagaggaaaagatgatcgtccaccttcaggctcttcttggtaataggngggcggccatagcttcgtaccttcctcagaggactgacaatgatatcaagaactactggaatacccatttgaagaagaagctgaagaagcttcaaggccaagcaaatcctgatgatgatgaccataatcatcacccacaagggttcaacgcaacttcacactccaaccccaagggccag

SEQ ID NO: 1504 - DNA, 468 bp, Eucalyptus grandis
agcacggtctcatgagcactcgcaattagaaattaatcctccatcagaagcatcaaaagagccactcccagatgaaccatctcttatgccaaatgaggattcacatcagctctctccatcagaagctaccacttccatggccgaatcctctgatttcgttagttccagtcacaaatgggaagctcttcccatggttctagagaagcccactgaagatgggtataattggaggaagtatggccagaagcaggtcaagggctgtggttttcccaggagctactataaatgtagccatctcaattgctcagtcaagaaaaaggttgagcattctcttgatggtcgtataacggaaattacttacagagggcaacaccagcatgaaatgcctcaagccaaaaggacttcaaaagatggtaacaacttgaacaggagcacaaattctctggctaaatctcaagctgttcttca

SEQ ID NO: 1505 - DNA, 415 bp, Eucalyptus grandis
caagctacaatggtgattcatatcacttgatatttaagaattgcaaccacttctgcaaggatgtttgttacaagctgacagggaaaccgattccaaagtgggtcaatcgacttgcgacaataggttctgcctgcgactgcttccttcctgaaacccttaagatcactgcagtacgtcatgaacctaactgccaaccatgcgaaagtgagaagcggaggttaacaaacaacttcagttgcctgtcttctatatcaatgaggcagaagcagttatctacatcctcattattccttcgttctcccctgagaggctgtctaccgccttgggaactcaaaaggtctaacaatggctccttgaaggaaagatgagaaaatgcccagagtgaaactacatcacaagcgatcatggagcgctg

SEQ ID NO: 1506 - DNA, 512 bp, Eucalyptus grandis
  misc_feature (1)...(512): n = A,T,C or G
ctctattccactcctaattcatgcttttcgtgacaataattttgtagcatgctcaaaactctagagagatatcagaagtgcaactatggagccctggagccgaacgtgtccgcgagagaatccttggagttaagctgtcagcaggaatatttgagacttaaggcacgttacgaagccctacagcgaactcaaaggtattgaagtttctattgtccttttaattaaatgtcagcattcgcgggatgtagttattttcctacatgattggggtctatctgtgtcatcgngaactaggaatcttctgggagaagaacttggccagttaagcagcaaagaactcgagtccttggaaagacagctagatgggtcattgaagcagatcagatcacgaagagtatgtaaattatattcacgaattctatctaagtcacatcctgagttattgngaatacaagttactgnngtcaatcgctgggattagtggtcatcggtctggctaactttagtagcga

SEQ ID NO: 1507 - DNA, 342 bp, Eucalyptus grandis
tctagaacaagatcaacaggcaagtgacgttcgcgaagaggaggaatgggctcctcaagaaagcctacgagctctccgtgctttgcgacgcggaggtcgctctaatcatcttctcccatagaggaaagctgtacgagttctgcagcagctcaagcatgctcaaaaccttggaaaggtatcaaaaatgcaactatggagcaccggagcctagcatctctacccgggaagcacaactggagctaagcagtcagcaggaatatctgaaacttaaggcacgctatgaagccctacagcgaacgcaaaggaatcttcttggggaagaattaggccctctgagcagca

SEQ ID NO: 1508 - DNA, 413 bp, Eucalyptus grandis
atgacctcgaactaaaagtgcgagaactggaaactgtcatgctaggacccagctcagatatgccccacacggttgatatcaacttcttggttggatctggccagatgtctcaggagacggagacattgatggagattatctccaggagggacctaaaggagattctctgtgcttgtgctaaagcagttgaagacaacgacaccttaaaatttgagtgtttaatatcagagttacgcccgatggtgtctgtttccggtgacccgatccaacgattatcagcatacatgttggaagggctcatagcaagattggcaagttcgggaagctctatttacaaagctttaaagtgcaaagagcctgctggtgcagagctgctatcgaacatgcacattctctatgatatatgtccttat

SEQ ID NO: 1509 - DNA, 296 bp, Eucalyptus grandis
attgaatgaaccgggcatttcgggtgaaggaatacaagaagcccgcgccgtgcaaaattcaacagattcggagattgtaggtgatggatttcggtggaggaagtatgggcaaaaggttgtgaaaggaaacccgtatcccagctactatagatgcaccagtgtcaagtgcaatgtgcggaagcacgtcgaaagagcttcagaagatccgagagcctttataacaacatatgagggaaaacataaccatgagatgccactaagaagtaccacacagcaggctcagagtccgatctgca

SEQ ID NO: 1510 - DNA, 441 bp, Eucalyptus grandis
attccttcttctctctcttcgaaaaccctttctctctcttcgatctctctctctttctctctcctctgtgattgcagatcaggctcccacgccgttccattcgcgcatctccgacctcctctctccacgcggccactgtcccgtcgcgcgaattcaccccgccgtcgtaggagaccgcatcctacgccgccgcggcgatggcggcgccacgaggagatgccaggggaaggaatcaattacttcctcgttactggcccaggataacagatcaagagctacaacaaatctctggagactcaaactctgtaatcactcctctgtttgagaaaatgttgagtgctagtgatgcaggtaaaattggacgtttagtgctgccaagaaaatgtgccgaggctattttccggctatttcccagcctgaaaggatttgccgtcaaagttc

SEQ ID NO: 1511 - DNA, 315 bp, Eucalyptus grandis
  misc_feature (1)...(315): n = A,T,C or G
tgatgggaaactctcatgttcttccaatctgaagagcttcttcacaacagctgcgtcacgaggtgatttccagattcaatggtccgagttcgccggacgcggcggcgctgccggtagcatctaaaagcattgacctggaaagaaataggaggaagaagctcaatgaaaggctcttcgcactcagagcccttgtacccaagataagcaagatggataaggcttcgatagtgaaagatgctattgattacatccaagacttgcgtgaacaagaaggnaagatccgagccgagatcgcagagctcgaatctgtaattc

SEQ ID NO: 1512 - DNA, 409 bp, Eucalyptus grandis
gagagacagaagaattagaacgacacgaacaggcaagtgacctactcgaagcggaggaatggcatcttcaagaaagcccacgagctcaccgtcctctgcgacgctagggtttccatcctcatgctctccggcaacaagaagctccacgagtacatcagccccaccaccacgacaaaaaggatgattgatgattaccagaaggctcttgggatcgatctgtggactacacactacgatagaatgcaagaggagttgaggaaactgaaggaggttaataacaattttcggaaggaaataaggcagatattgggccacgatttgaacgagctgagctacgcagaactgcacagtctccgagcagacgatccgagtcttctgtcaattcaagtgcgggaaagaaagtaccatg

SEQ ID NO: 1513 - DNA, 323 bp, Eucalyptus grandis
ggagagagttgagaggcctgagacatataagcagtggcaaatccgcaacacgagggcgggttttaagcccctccccctggatcccgtaattatgaagaagctgaagtcgaaattgaaagaggggtaccttgatgatttcgtggttgacaaagatggtcaatggatgctccaaggatggaaaggtcggattctttatgcttcctcctgttgggaacctgtgtagaatttctccaagtctttatatgcttgtccttttggtgtgagccggggatagtttatgacgaccaaggaggaagctgttggctgattcgtggcaagtaagg

SEQ ID NO: 1514 - DNA, 285 bp, Eucalyptus grandis
  misc_feature (1)...(285): n = A,T,C or G
gtaatggaangccacgaggagatnccaggggaaggaatcaattacttcctcgttactggcccaggataacagatcaagagctacaacaaatctcaggagactcgaactctgtaatcactcctctgtttgagaaaatgttgagtgctagtgatgcaggtaaaattggacgtttagtgctgccaagaaaatgtgccgaggcctattttccgtctatttctcagcttgaaggattgccactcaaagttcaggatgccaaaggcttcggagtggatatttcaatttcgt

SEQ ID NO: 1515 - DNA, 290 bp, Eucalyptus grandis
aaaacactagtggaggcccagaattcggacacgaggttcagttagtggtgatataagttggcaaggcactgacaaacatggactccctagggatgccttcttgcttcccggaatgtcggccccagagaggaaaagagcacgcaacattgggtccaaaagtaaaaggctgttgattgacagtcaagatgctcttgagctgaaaatgacatgggaagaactccaggatttgcttcggccaccgagtgttaacccaagcattgttacagttgaagaccatgagtttgaagagt

SEQ ID NO: 1516 - DNA, 357 bp, Eucalyptus grandis
  misc_feature (1)...(357): n = A,T,C or G
gttcagttagtggtgatataagttggcaaggcactganaaacatggactccctagggatgccttcttgcttcccggaatgtcggccccagagaggaaaagagcacgcaacattgggtccaaaagtaaaaggctgttgattgacagtcaagatgctcttgagctgaaaatgacatgggaagaactccaggatttgcttcggccaccgagtgttaacccaagcattgttacagttgaagaccatgagtttgaagagtatgatgaacctccggtttttggaaaaagcagtatttttatacttcgctccactgggggacaagagcaatgggttcaatgtgatagctgtggtaaatggagaa

SEQ ID NO: 1517 - DNA, 416 bp, Eucalyptus grandis
caagattcttctcccctttcgttccttcgagggtccaaaacttctctctttctctctctgtgtgcggctggaagagagatcttggaggctgtgaatcttggtttctttctcttttggttgacgggtcacataacacgaatctagggttcttgatctttggtgggtgtctttcgaattcgaaggaagaaaagccaagaaacaagaaaatgggtgtggagaccacctccggatcgggctcggaatgcgagacgcgtgtgatgctgaacgtctacgatctcacgcccattaacaattacacccgctggttcggcttcggcatcttccattcgggcattgaagttcatggcaaagagtatgggtttggtgcccatgacttccctgttagtggggtttttgaagtggaaccaaagagctgc

SEQ ID NO: 1518 - DNA, 218 bp, Eucalyptus grandis
attcgaccagtgtcggtaccaaaaccaccacggctctccccatctcctccggccgaaagccctctcaatgaagcgggtgggagtccctccgaaacccaacaagctttacaggggagtgaggcagaggcactgggggaaatgggtggctgagatcagacttcccaagaacaggacacgcctctggctcggcactttcgacaccgccgaggaggctgctc

SEQ ID NO: 1519 - DNA, 337 bp, Eucalyptus grandis
  misc_feature (1)...(337): n = A,T,C or G
ctcaaaccagaagggccttcctctgcggnttcaagatgtaaagggaaaggaagtgggtgtttcagttcagattttggcccaataataacagcagaatgtacgtgttggagggtgtaactccttgcatacaatctatgcagttacaagctggagacactgtaacttttagccgcatggaccctgaagcgaaacttataatgggtttccggaaagcatcaacctctatgatgcaggacagccaactagctgctgtttctaacggtaaccattcaagtgaagctttgatttctggtggttttgaaaatgtacctatgataagtgggtattcgagtctcct

SEQ ID NO: 1520 - DNA, 439 bp, Eucalyptus grandis
gagcgcttggcggcctctgataggagaccggccaactgcttcgaatgatgcaagtgatggaccggtaacaggacttgcactgtcaaagtgccgcacgctcatcggtctgccagaaactcacggagagagagagatggcggagagagaggagaaggggaagtacgacgagatgatgatgaagaaggggagcgacggagggatagcggaggtgaatcccacgccgaagaagggggtgacgtccaaggttgtggactacattgagaagctgatcgtgaagttcatgtacgactcctctctgcctcaccaatacctcgccggcaacttcgctcccgtcgccgacgagacccctcccgtcaccgacctccccgtcgtcggccatctccctgattgcttgaatggagaattcgtccgggtgggccccaatcccaagtttgccccg

SEQ ID NO: 1521 - DNA, 448 bp, Eucalyptus grandis
attggattctaccggaaatttgcgcgccgttgggggttttttgatgtcggaggatggggtcgtcgcagaagtgcatgaatgtgctgtgcgaggagaaggggtcgaccgagtggaagagaggttggcccctccgatctggtcaactcgccaccctctgcgataagtgcgggtctgcatttgaacaggccacgttttgcgaagttttccactcgaaggactctggatggagggagtgcgcttcctgtggcaagcgcctgcattgcggatgcattgcttcgaggatgctgctggagctgctcgattgtggcgggatcaactgcgcgacctgtgcgaaaagttcaggacttctgcctatcgcaagtgatgagaggcctagtgagtttggcatgattaatgttcgtactggtgaactgcaatctagtaccacagacaaccatttcgatagcga

SEQ ID NO: 1522 - DNA, 439 bp, Eucalyptus grandis
cacaacacccccatatcagtaaacacttctcgctgctccagccagcttctgtctcatataaacactagccccacctcactcattatccgcttcgctcctactcaactgctatcgcgctatcccagcgcagacgtcctcccatgaacttctccgacaaggaagtgcagctcgcgtccgaccacccgaagaagcccgccgggagaaagaagttccgggagacccgccaccccgtgtaccgcggggtgcgtctgcgcgactcgggcaagtgggtctgcgaggttcgcgagcccaaaaagaagtcgaggatctggctcggcaccttccctactgtggagatggcagcgagggcgcatgacgtggcagcgctcgcgctgagaggccagtctgcctgcctcaacttcgcagactctgcgtggcggctgcccaagccggcatcgac

SEQ ID NO: 1523 - DNA, 361 bp, Eucalyptus grandis
gcctggtgaacgaagttttcgagagtggccaactttcccatcgcaatagccatttggcccatgtattctgcgacgttgcctgaaccagtaggactcagtgtggtcgaagaaagcgtgtccacgagagattgctgcagagcttccattccctgagataaagcatcttcagcctgttgtgaagattgctgcagattacatatgcccatcaactgttgatccgtcaaaggctccaggtggttccctagtatcttgagaagttcagatgaacggaaaccgcccaaccacatgaaacacctctcggcgggcgtcttccacatgccagagagtatgtggaacacatcggccttcgcacctatgttct

SEQ ID NO: 1524 - DNA, 422 bp, Eucalyptus grandis
ccgactcagcaaagccaaagaaagaaaccagaaacagcagaccagaccattccattccattccatttcgcattctctactacagactcgcagagatggtgaagagagacagagaggacgcggaggtcgaagccctggccgtggccaactgcttgatgctcctcccccgagtcggcgagtgcgccgactcgaaccgcgaatcgcggtctacagagcggatgttcgcgtgcaagacgtgcaaccgcgagttctcctcattccaggcgctcggagggcatagaaccagccacaagaagcagaagctgatccccggcggcctcttccacctcggctgcaccgcggattcctcgccagccaagccgaagaggcacgagtgctcgatatgcggcctcgagttcccgatgggccaagcccttggcggtc

SEQ ID NO: 1525 - DNA, 443 bp, Eucalyptus grandis
ctcgatgatcgacacttgcacgctagtctcggatggcgtgggctggagaggaggtggcggcgactccacggccttgggcttggccccgctgccgccctcgacgatcctcattttcctcttgtcagacccagacccgggcaagcttgctcgggaggaccgttctactgacgaggccgcgcttcgtagatccttcaaactagtcgtcctctgcaactctccttgttttgtcctgtggtcagcctccatttgtcgattcctcgcctcgagatcttggatcttcttcctaagttgcttcacatattctatggtatcccccaatatggaggccttatccattttggtcacgaacggcaccagtgacctcagtataatgaacctctcgttgagcttctcgcggcggcggcgctccgccaggacatggttggcgctgagctcgtcctgcg

SEQ ID NO: 1526 - DNA, 379 bp, Eucalyptus grandis
gtcctccacagttgcggcagattgtaaaagttcccacgcactcgttgctcatatgacccacctgctgacagttcctacacacgacatccctgaaaccgccaccgccaccgccgccaccgccgccaccgccgctgcgcccaacaccaccacctcgctctcccatgacattgcctttaggacactgcctagccacgtgcccagatatgttgcacatattgcagactggctcattcgggcaatcacgtgccaggtggccagttttcctacagttgttgcatgccttctcattcgtacagtcagctgcaatgtgcccttgcttgtagcagttgttgcatagcctcaagtcaccaggaggagcgctgcattctctagcaatatg

SEQ ID NO: 1527 - DNA, 419 bp, Eucalyptus grandis
gttacattgattgacatgtgaacccgtcttttctttttttttcagtagtggcaatccaccaaggcgggcgaggctagtatgatgggctgttgacttgtggcgaattggaacttcgagttctcccggcggcggtgcgcttggtggtggtgatcctcctccgtcggggccggcaggttcaggtccaaggagaggatgttgcgggacttctcggtggtgatggccgcagcagccggcgggttggtggggctcgtcgcgtcggcgctggtggccgtcggcggcggggcggacctgtgccgcctcatgtggccgcccaaggcctgacccgacgcgaactcggacccacatatgttgcactcgtggatcttgggcttgctcgcttgatggagccccttgtggctggccacgtgggcggagagggg

SEQ ID NO: 1528 - DNA, 381 bp, Eucalyptus grandis
cttgcctcacgattgaagaagaaaagagcagcagaagaagcgtttccgttgctatggtcattattttgagcaatcgcagaacgggcaactgagcggttcatcttttcggtggccctataaacaactcggtctcaacatccatagactccgcgcggatttcttcacgaggcggttcgctggagaccggggtcaatcctttgccgcattcaatctcttgaagtagctttctcttttcttccagtagtttccgctcctctgcttttagccgctcaatatgctccctaattaaatggttctttcttgccctgatcttggttagacttctttccaactggttttctgtttgttggagctcctcgaccgaacaggaatccagaccct

SEQ ID NO: 1529 - DNA, 524 bp, Eucalyptus grandis
ctctcagcataatctctctctctctctctctctctctctctctcctgcgctctgcgcaggagcttattcttttattcttttcttcttcttcttttctgttgggtagatttgtaaattagtagggcgaaatccggaccttcttcttcttgctcccctttcttcctgcagctcgaatcgtatcgtttcgtccgtccgtccatccgatcgacatggccgcagtcttccagctcgacggcgaccgcgctgccgacgccctccccgattcgccggttgtcgatcaggagaaaatgccgatcgcgacgagccatgattatgctaatcatgggggggtttgtgcgatatgcttggagaagattgtgctccaagaaactgccctcgtaaaaggttgcgagcacgcctactgtgtgatatgcattctccgctgggcctcatgtaaggagagaccaacctgccctcagtgtaaacatcctttcgacttcctcaacgttcatcgctcgctcgatggcagcatccgtgatacatgt

SEQ ID NO: 1530 - DNA, 185 bp, Eucalyptus grandis
  misc_feature (1)...(185): n = A,T,C or G
gaactggctgtctgggatcaacatagggaagcgagtgcacatgtttatcaaaaggacccagaggtccagatgtagtcctaacagatnggctgtcaatactagcacaggggatttcaccagacatcggctgcccattggttagaagagggattggatgtcgagattcatgtctagaagaagaagaa

SEQ ID NO: 1531 - DNA, 385 bp, Eucalyptus grandis
tcagctagccgctccacccgcttcttcacccggcagttgtcctgcgtgcagcggtagtagcttctgggatgttgagtgttcttgaccaccttctgaccgtacttcctccatttgtacccatcgtccaggacatccacatcgctcatggtcttgaagcaaaacctcggctccctcaccttcctcctcccctttatcttcttcatcttcaaggctgaaacccccatgctctggtggtggtggtgatcacgataatgatcgccatgatctccaccgccggatgaggatctcatgaccaagctgctctggtcactcaactcaccccatgcccagagattcggggttgatctttgcaaagacagaagctgggggcctcccaagagttcag

SEQ ID NO: 1532 - DNA, 153 bp, Eucalyptus grandis
tcggggtcaatccatctggtgcagaacataaacgcctgctttggtcccaggcattttctgcacaggtccacctaggaggaagaagaacatctactggtaaccttctccatttaccacagctatcacattgaacccattgctcttgttcccccc

SEQ ID NO: 1533 - DNA, 417 bp, Eucalyptus grandis
cagaaagtgactcgccctagtgtaggagtagggagaggcttggatgcacattccatttcgcctccttgaagccctccaacggcgcagatatttccttgcttttttaggcaaaatgttgaaaaactggtgataataaaaagaagccctgtttagctataaagggaagccccatcctttctcctccctttctctttcttacctgtccccccctcccctctcctggctctcgctctctctctctctctcagttctttctcggacgggtgtctgtgcgtggcttttgatcggtcatcacctgaggccgcgtctgcaagcaagtgaagaaggaggacaaggaatatggcgagagagaagatcaagatcaagaagatagacaatgtgacggcgaggcaggtgacgtttctaagaaggagacga

SEQ ID NO: 1534 - DNA, 574 bp, Eucalyptus grandis
gtccttgtgacgacaaagttccgggaaatacttcgccaatcgcctttcccatatttatctaggcctagaagaaataacctgtgttcttcctcggtccaagcaatccccttccttctctcctgatccgacctcgagcctttccctccctggtttgactcgccgctaccgccgccgcccttcttcctgctctcctcctcccctaagttactggcggagccatccgagcaagccgaactgtaggacggcagaggcacgcggccagcctctatcctattgacatcttccaccaggtcctcgtagtggagcttaatctcctctagggttttgccgggcacgtcggacgctaccttctcccaccaatccggggaaacctcgaagtgggtagccagggcattctcgaacgccttgtcctgttccttactccacgaggaacaactagggctcactgcttcatcgacagtcatcaaagcaaaacccacacacccttccaactccgaacgacttcacgcgactcagcagcgcgaccaaatgaaactcgacggcaaaatctacggagctatcgaaccaaccccaa

SEQ ID NO: 1535 - DNA, 497 bp, Eucalyptus grandis
  misc_feature (1)...(497): n = A,T,C or G
accgacctcctctctccacgcggccactgtcccgtcgcgcgaattcgccccgccgtcgtaggagaccgcatcctccgccgccgcggcgatggccccagcttcattccctgcgctagcaacgcatttcaatggaagtatgctcaatgatactaactcatctggtgaaagtcacacacgtaatggaaggccacgaggagatgccaggggaaggaatcaattacttcctcgttactggcccaggataacagatcaagagctacaacaaatctcaggagactcgaactctgtaatcactcctctgtttgagaaaatgttgagtgctagtgatgcaggtaaaattggacgtttagtgctgccaagaaaatgtgccgaggcctattttccgtctatttctcagcttgaaggattgccactcaaagttcangatgccaaaggctcggagtggatattcaatttcgattctggccaataataatagtagaatgtatgttctggaa

SEQ ID NO: 1536 - DNA, 454 bp, Eucalyptus grandis
gttcttcctcgtctccatgacgcatccttcggcaacgacggcagcttgcccggccaggccctgtacgggtcgaccccgctttgggtgtcgggcggggaccgcctcgccgactgcggctgcgagagggcgaacaggcgcggattttcgggctcaacaccatggtctgcgtccccgtgatcggcggggtcgtcgaattgggctccacggagccgatctaccatagcccagatctgctgaacaaggtcaggaatttgttcaatttcactggtgggatggaattagggtttggtgggaatggtaacgatcagggcgagagcgatcctttcttcgctctggctcaatgatccggcgggcacggtcgaggtcaaagacagcgccgtcgccgggcggccgccgtcaagggttcttcgaattataacggtagcaatcatgggtctaaatcgattcaactcga

SEQ ID NO: 1537 - DNA, 266 bp, Eucalyptus grandis; identical to SEQ ID NO: 435

SEQ ID NO: 1538 - DNA, 426 bp, Pinus radiata
gcatattctatatgaagtttgtccttatttcaaatttggttatgtagctgcaaatggtgccatcgcggaagcatttaaagacaaagacagggtgcacattattgattttcagatcgctcaaggtagccagtgggtaacattaattcaagcatttgcagcaagacaaggtggttcgcctcatgttcgcatcacaggtgtggatgatcctcaatcagagtatgctcgaggtcaaggattaaatttagttggcgaaagattatcaaagcttgcagaaagctaccaagttcctttcgaatttcatggtttgtctgtttttgggtctgacgttcatgctgagatgcttaagattcggcctggggaagctttggctgtaaattttcctttgcagctccatcatatgcctgatgagagtgtgaatacaagtaa

SEQ ID NO: 1539 - DNA, 447 bp, Pinus radiata
cgacggcgtggtttttacacagtcttcggactcttcttgctcggagtcttcccaaccacggccggcaaagaaatacaaaaaaacccatagcaagaaagcccaagacggctctcagccacgaaggtgcagccattgtcttgtacagaagactcctcagtggagagccggacccttgggaccgaagacgctctgtaatgcttgtggtgttaggttcaaatccggcagactcgtaccagagtaccgcccggcaataagccccactttttttgagcgaggttcactccaatagccacagaaaaatcctcgaaatgagacgccaaaaagaagaagaacaacagaggccagagctaacgtcccagacgtgttcaagcggcgccaacgagtcattttcagacaattctttaccgtctgaagagtcccttctagtttaacccacaggcgtgaaat

SEQ ID NO: 1540 - DNA, 382 bp, Pinus radiata
  misc_feature (1)...(382): n = A,T,C or G
gaggaaatgggtgtcggaagttcgaattcccaattccagtggcagaatttggttgggctcctacgacaccccggaaaaagctgcccgtgcatatgactttgccgtgtattgcctcagagggtccaaggccaagttcaattttccccactctccgccgaaattttcctgcgcttcatttctatcaccgcagcaaattcaaaccgcggcggccaagttcgccgcagaagaattccggcttctttccgaaaatggcgcggcatcctcatcatatggtttggaaaaggnntatgacattaatagcgaacagattacttggaagcagggtgcgacatttggggattcagtagcatttgaaagtatggagaatggcggatctttcaac

SEQ ID NO: 1541 - DNA, 368 bp, Pinus radiata
  misc_feature (1)...(368): n = A,T,C or G
ggtgattggagagggaatagcacggaattttgtcataacacgaacacctacaccaggtagccagccatgccccagaaatattttattcgacagagcaatatgactagaaagaagagacgttccagtctgtttgacatgacgccggtgagttttttcttcctgtcttaaattcttggtgtggtgggcatggaagggattcaggaggcgtcttgggcaaagatcccaaaaattggatttgcaatcaatcatgattcataattgttctgaaaattatgctaagaactaatctcatctttcaaacctcaaatggtattcttttgtttgaagttgnttctaagtttctttaatgtctattcataatttcattt

SEQ ID NO: 1542 - DNA, 370 bp, Pinus radiata
caagcctagagtatgatttggcctaccaggccttctatcagcttcttccttatcacaaattcttgcacttcacaagcaaccaggcaatacaagaagcggtggacaatgcttctaatattcatatcattgacctcgagatcagacaaggccttcagtggcccagcttcatacaatcgctagcccacaggcctggaggacctccgaagctgctcaagatcacagcgataggacaagacgagaagaggctcaaacagacaggtaggcgtttgcttgagtttgcagaatcaatggagattgcatttgcttttcacccggttgttgtggacttggagaacctggatgaatcggccctcaatataaaagcccacga

SEQ ID NO: 1543 - DNA, 404 bp, Pinus radiata
gcggagtatgttcaaagcgggtggtgatttagccgagggcgaagaggaggacgaagaagggcttcgtaacaaacgtggcgattgatcctaccttagcctgaaaatgctgtcaggaggctacgcaaccagatccgacactactactgtcaacaacggatccgctaatggcccaataggaagtgctcccccaagaattaactcgatacaaaataataatccaggagctgtcaggcctggctggggaaccatgccccttcacatgaatccttatcatccccaatcaatgcctcttccgccccccaatggtatgcagggtcagcttgtgtgcagtggatgtagaactcttcttgtttatccgcaaggtgcaccaaatgtttgctgtgcagtatgcaacacagtcactc

SEQ ID NO: 1544 - DNA, 339 bp, Pinus radiata
tatgtctctgcatttcagccagtccatggtttcaagttagttagtccaataaagcagagatgggtcgtgctccatgctgcacaaaagttggtctcaacaagggagcatggtctgccgaagaggatagtcttctgggaagatatattcaaactcatggtgaaggcaattggaggtctctgcccaagaaagcagggctgcgaagatgtggaaagagctgcagattgcgttggctaaactatcttcggccatgtatcaagcggggaaatattacaacagatgaagaagaacttattatcagaatgcatgctctcttgggcaaccgatggtcgataatagcag

SEQ ID NO: 1545 - DNA, 395 bp, Pinus radiata; identical to SEQ ID NO: 508

SEQ ID NO: 1546 - DNA, 390 bp, Pinus radiata
gttctgtcaagacccagcaagaattttgttccgggtttgaaggtgggagaagtgaggtgattcctcctttggaagatgtggaagggtccacacccacgattggggggaggaagagaaaaaatgtttacagaggtatcagacagcgtccatggggaaaatgggctgcggagattcgagatcccagtaagggggttagggtttggcttggaacgttcaacacggcagaggaggccgccaaggcctatgatgcagcggctaaaaggatccgaggtaagaaagctaagctaaattttgctgataactcgtgttctgttaaaaatgacactagcaagaaattgtcaggaaaagaaaggaaagttgtgctcaaaacaccctgcttttgttgttaga

SEQ ID NO: 1547 - DNA, 447 bp, Pinus radiata; identical to SEQ ID NO: 548

SEQ ID NO: 1548 - DNA, 357 bp, Pinus radiata
cagaaatcttgtgatccttgtgattataatcaaaggtcagccttgcaagcaaccgtgaagctgtgttcagttcagagcttctcttgcccgatggattcggagcttatgatggatgccatgcggaacctttcgaataatggattcgctacttcttccatggaaatgttagcggttatgccggatcagattactgtcgaagcaccaccggattcgtcgacgttgttcgcggcaccacgcaatggccgattggcaggggagcggcgggcaaggccgcatccgagtcaagtgctcaaatgccctcgctgcgattcgctaaacacaaagttctgctactacaacaactacaatctctcgcag

SEQ ID NO: 1549 - DNA, 395 bp, Pinus radiata; identical to SEQ ID NO: 414

SEQ ID NO: 1550 - DNA, 634 bp, Pinus radiata
gtccgctcgaggtacgcaaagcacctacgcagcggcattcgaactctctacccatacgtcagatttcacagtgacccttgaatacaggtaagcgtaaggatgaattttgacaatggaggatcacggaggggacgacgcattcagagtgatgtagtagggagacgcacatttcgtcgcagcgagccttatagactataccctaatgataggaatggatatggtcccaggtcttccaggcctattgagctttgtaacaactgcaagcgaacagggcactatgcacgagagtgtccaaatgcttctgtatgcaacaactgtggagtttcagggcacattgcatcgaagtgtccaaaagagcaattatgcaggaattgcaagaagcctggtcatcttgcagctgattgccgcaatgagcctgtctgtaacatgtgtggtaaaacaggtcacatggcaaaggaatgttctgctcatgagctaggacttccaaaatcagcactctgcaagaagtgctatttgcctgggcatattatggcagactgtcctaatgataaggcctgcaataattgtcgccagactggccacttggctcgagattgtatgaatagcccggtttgcaatggctgtggtgaacctg

SEQ ID NO: 1551 - DNA, 612 bp, Pinus radiata; identical to SEQ ID NO: 477

SEQ ID NO: 1552 - DNA, 562 bp, Pinus radiata
gtcatccatattttctttttcagtctgcaatacaaattgttattcgagatacgattgatcatgcttgaaggctatgcctatgcttgcggaaacataccgtgacagctttgagacgacttcgggaggtagcagcgtggatctggtaggaatggctctaccaggtttggcccctaatttgtcttctgcttcagtttcagcttcagcgtcggaagattctgccaagaaaataaggaaaccctataccatcaccaagtccagagagagctggtctgagcaagagcacgataaatttctcgaagcccttcaactatttgatcgtgattggaaaaagattgaagcttttgtaggatcaaagactgtcatacagattcggagtcatgcacaaaagtacttcttgaaggtccaaaagaatggcacaagagaacatgtaccacctcctcgtccaaaacgcaaagcatctcatccatacccacagaaggcctcaaaaaatgttcctgtgtcacagcaagtatcaactgcttttccaactgctgctactcaactagattctggatattatcca

SEQ ID NO: 1553 - DNA, 392 bp, Pinus radiata
caacaatgttccatattgagacctacttttgtccgcattgcctccactccagaacgttgtattttctttaatgcattgcgcctcaatatcttctcttttgattgcacagtcgccaaacccatgcttctataccttgagactaatgcacgagaaagagcaacatctctctcaaccgttgggcgtggcctctgacggtaataacgaagaaattcacgagaaccaagcatcttgcatgttgttccattttcagactttctttggattaccagttcagcccctccaaagccaagttcaatattgacattgagattttcttctgtgggcactatttgcatcccactttcatccgtgtaactgctgctgtagtcataaaagtcggctaaatcactatc

SEQ ID NO: 1554 - DNA, 570 bp, Pinus radiata; identical to SEQ ID NO: 546

SEQ ID NO: 1555 - DNA, 392 bp, Pinus radiata; identical to SEQ ID NO: 521

SEQ ID NO: 1556 - DNA, 364 bp, Pinus radiata
ccttaccgaggggaagcaacgaggtgtttctcttttcccacaagaagatatcaagcaaatagttacacaccaagaaaatccacaatgggtagatctccttgctgcgcaaaggaagggctcaaccgcggggcctggacgaaaacggaggatattattctctccgaatacattcgaattcatggcgatggtgggtggagaagtctccccaaaaaagcagggcttaagcggtgtggaaagagttgtagattacgttggttaaactatcttcgtcccgacattaaacgcggagacatttccccagctgaggaggagctgattattcggctgcaccgccttcttggtaatcggtggtcgctgatagcag

SEQ ID NO: 1557 - DNA, 355 bp, Pinus radiata; identical to SEQ ID NO: 416

SEQ ID NO: 1558 - DNA, 478 bp, Pinus radiata
aaaaagctgtaaaacggtatatatagagcgctctccagtctaacatcttggattgattgttttctgttagaaattcccatcatccctctgtgtcttcctccttttgaatccagagactgtttttatggtggctgtaaatgctgaaataatgcccaaattcgaagggaagtctgcgaaatccctggattcaacattcaagctgttcggcagaacgattgctgtgaaaaatccctgtgatagcagcagcaatggtattcatgtcgatgggattccagctgaagcagtgaattcagcagtccccaaggcttctgaaacgcatcatcatgatgagaaacagaagcagaatgaggattcagaaaaggtgggtaaaaagcccacaaagcttgtgccctgccctcgctgcgagagcatggataccaaattttgctatttcaataactataatgtcaaccagcctcggcattattgcaggagatgc

SEQ ID NO: 1559 - DNA, 389 bp, Pinus radiata
agaaggttggaatggcttagtccgctcatttgatggcgaacagatctttgtggggaggttcagactttgattatgagaacgaagccgatacgaggaagggtccatggactgtggaagaggacatgcagcttggtattgtaaatttgcacggagaaggacgctggaactttctcgccagagcatctggcctccagagaactggtaagagctgccggctaaggtgggttaactatctccggcctgatctcaagcggagcaagatcactcctgaagaagaacgtttgattattgaactccatcgccgttggggaaataggtggtctcgtattgcacaaagtttaccgggaaggacggacaatgaaatcaagaatttctggagaactcgtatg

SEQ ID NO: 1560 - DNA, 354 bp, Pinus radiata
agatgcctcgggtagcagtttacaagagcctgaggagaatgatgaagaacttgctcaagctcttgaagcaagtttgaaaatgggttcacagcaaaatcctcccagtcagcctccatcatactcttaccctagaggatacaggatctgtgctggttgcaatcatgagataggctatgggcggtttttaagttgtatggggaccttatggcatccagattgtttttgttgtgttgcatgtagtctacccatacgtgaacacgagttttccatgtcagggaatgatccataccacaaatcctgttacaaggaactccaccatccaaaatgtgacgtttgccaccagtttatccctac

SEQ ID NO: 1561 - DNA, 248 bp, Pinus radiata
gccaggtgaggcattggcagtcaattttgcattccagctgcatcacatgcctgatgagagtgtctctaccaggaaccccagggatcaacttttgagaatggtaaaaggcctgagtcctaaagttgtaacagttgtggaaagggaaatgaacactaatactgctcctttcctccctcggttcatggaggcactgaattactactcagctgtgtttgaatccttggatgttagcctcgaaagggaaaacc

SEQ ID NO: 1562 - DNA, 346 bp, Pinus radiata
tctgtaagtgcttgagggcttcttgtatcgatgaggccattaacgatgggaagatcttttagttgttggagctgttcaaaagataatggccacgagcgtcttaatcgtggatcttggagtgctgaggaggatacaattttgagtgaacatatcaaaactcatggagttggtcgatggacatctcttcccaagaaagcaggtctaaaacgatctgggaagagttgcagattacgttggtttaactatcttcgttcagatatcaagcatggaaacatttctccggaagaagaggaactcctcatcagattacatcgtctccttggcaatcgttggtcgttgatagcag

SEQ ID NO: 1563 - DNA, 354 bp, Pinus radiata
gtttggggatatatcagaatgcaggacactgctgcttccacatctacacagcatcagtcaacaagtgaaaaatcttcaagttcagcagctccagccccatttagacaagccaaagatgcaattgagagcgatgatgatatcaggagggttcctgaaatgggaggaatgcaagcaggtccatctacatgtgtgcctatgaggttagacaatccccaacctagcacaggcgttgttgcccacaggaagagagggagagcccctgcagacaaggaacacaagcgtctcaaaagattgcttaggaacagagtatctgcccaacaggcaagagaaagaaagaaagcatacttaaatgat

SEQ ID NO: 1564 - DNA, 324 bp, Pinus radiata
tagctgccgagtgtacgaatgagaaggcatgcaacaactgtcgcaagaccgggcatcttgctcgtgactgcaccaacaacccagtttgtaatttgtgcaatatatctggtcatgtggccagggagtgccccaaggctcgcattttggatggtaataggggtggaagatttattgacgataggcgtggaagatttaatgacataatctgtaggacatgcaacgagccagggcataccagtagggagtgcactggaattctcatctgccacaacttgtggtggccgtggacatgttgcatacgaatgccccctctggtcgtgtgat

SEQ ID NO: 1565 - DNA, 421 bp, Pinus radiata
aacggaaacaggaccggactctggctgctgccctccctcattaaccattcctgtctgccgaactcgaggtggctgttagtgggaaatgccatttttatacatgcctccaaggccatcgggagtggagaagagatcactattccttattttgatgttctggctcccttgttacggcgccaagctgactgtaagaactggggtttcaagtgcaagtgtaagagatgcattctggagcactcattcaggaaattcctagaacctataattgccctaaagtttgagcaattggatgaccaagcaaaagaattgcttgctggattggatcatcgggaaagtgcagaaatgagtcaccgggaaaatgcagaatttgcaatgtttgttccagaggcagaggagatcatccggagttcccatgtgttga

SEQ ID NO: 1566 - DNA, 390 bp, Pinus radiata; identical to SEQ ID NO: 524

SEQ ID NO: 1567 - DNA, 353 bp, Pinus radiata
gtctaggggaaaagctttgaaattatttgggtttgagtttagagggtcagaaggtggatcatttgaagggactaatggttctgatcagccacaagatgggactaatatattaactgcaggtgaagcatccactgagccagtggaggaagaactagtgattgaggccaaaaatggagattcagggaaattagaagatgtgggtagtccagtagaggctggagaaagtggtagcactagcaattgcctgggatcatctgctcaagaaaatcggaaatatgaatgccaatactgttgcagagagtttgcaaattcgcaggctctcgggggccatcaaaatgcgcacaaaaaagaga

SEQ ID NO: 1568 - DNA, 436 bp, Pinus radiata
agtattgaaattcccctgttttgatctgatagctatggatctgatggagtcttttgaggcaaaggggaagggagagaagaggagaacggtgaggggaaaaacccagttgaagaggattgagaacgggaccagcaggcaggttactttttgtaagcgcaggaacggtctgctgaagaaagcttacgagctctcggtgctttgtgatgccgaagtggcacttattgttttctctccaagagggaagcgctatgagttcgctaatcccagcatgcagaaaatgttggcacggtacgaaaatttttcagaaggaagtaaagcaacgagtacagcaaaagagcaagatgtccagggtttaaaacgacaaattgcgaatatggaagaaagggttgaaattcttgaatccatgcatagaaagatgttgggggatagctggcat

SEQ ID NO: 1569 - DNA, 349 bp, Pinus radiata
gttcaattttttcacttgcagtggaaatagaagcctgcaggtacctctaggctaccggagttcaaatcccgcacgatcacactcccttcttttaacattccgagttcgaatccccggaaacttctcgacatggttaagccctcgcaaaaacagaatatccatgtcaatggcaagccggaaagccgctcactgatgtcgcggcaattcaagggaatccggctaaggaaatggggaaaatgggtgtccgaaattcgaatgcccaattgcagggccaaaatttggctgggctcctacgaatccccagagaaagctgcccgcgcctatgactttgcagcgtattgtctgagag

SEQ ID NO: 1570 - DNA, 580 bp, Pinus radiata; identical to SEQ ID NO: 541

SEQ ID NO: 1571 - DNA, 469 bp, Pinus radiata
gttgacggagcaggcagagcgcattggtcgcgtcaagattggcagcaacggtttgttgctgttggcgacgcggttaaaggtggcagcatttgacctggaaacacatgggatttttttcagagtggaagaagaagcagatgatgagattatcgttgaatctgtagatgttaaccgggacagggttttggtagcgtcaaatgacggtaatgctagggttcgtcgaatgaggacactcgaaaacatatgcaccttaccgtttgacggtttaggcggagcagatgataacagtagcggtagtaataacaataacaatagtagaaaaattcttgggactttgaatacatggctggcatttgtctgcattgacggtgtggtgcacgcttgggacgctgacagcggcgcacgactctaccgtttggtagaacaagtcggcgatgtgttcgatttggtatcagacaatgaacacgtg

SEQ ID NO: 1572 - DNA, 337 bp, Pinus radiata
gggaggcagagaaggaacggaaaaaggagtgaatttttgtgggtttgtgtttattgggaagatggggtgtgtgtcgtccaaggtggagaatgaagaattagtgaaaagatgcagggacaggaggaggctaatgaagcaggcagtgaattccaggcacaattttgctgcagcccacattgcttatttgagggctctgcaaaacacagggaatgctctggtacaatttgcggagggggaatccagtgctatgaatggcaatgctattgaagaagcggccacaccaatgccagcgaccccattaacagcatctcatcgccatcccatgaaattccatcct

SEQ ID NO: 1573 - DNA, 341 bp, Pinus radiata
gttctatactgtcacggtgtttcttttaatggctcgttcctcctccctcaccatggagaagaatatgtactgtagttctactattctggagtatgacactgaggaagggagtagtttagattgggaatgcgacatgtccgaggaagaagaagatcttataatcagaatgtacaaacttatcggcaacaagtggtcgctgattgccgggcgcattcctggaagaaaagcagaggagattgagaggtactgggccatgagaacccaacaattgtgcggcggcgatgatgctattttgacgaagaaacagcagaaaaccaatatgatatcgattaagtaccgcg

SEQ ID NO: 1574 - DNA, 479 bp, Pinus radiata; identical to SEQ ID NO: 540

SEQ ID NO: 1575 - DNA, 402 bp, Pinus radiata
attgatgggatcaccccttggaggaggacttggtctttcccctagaatgggtggagggattgggaatggcctcaaggaggattgggggtgggcttggcgggtctcggagctactgcgcttaccattggagcagcatctcccgccaaccagctttcttctgatggtatgggcaacagccatggagacaactcaacagtatcgccaattccttatgggttggacgtaagtgtaagaggcaggaaaagaggtggaccggtggagaaagtagttgaaagaaggcagagacgtatgataaagaatagagaatcggcagcaaggtcgcgagctagaaaacaggcatatacccgttgaattggaagcttgaagttaccagacctcaaagaagagaacaaggaattgcga

SEQ ID NO: 1576 - DNA, 355 bp, Pinus radiata
cttcagccgcttggagtccacttcccagctgctacatccgttgtcctccagcgcactgctgccatcgtgggagaagccgtcgctgctccgcttgcgagcggcgtctaagctgctgatttcgtcgtccaggtggacaacgatgcccttttcggggtcccggcagcgcctccgtagcgtggagttccagtggttcttgatcgcgttgtcggtgcggccggggagggctcgggcaattgttgcccatttgttgccgtgctgcgcgtgggcctgcagaatagcagcatcctcggacggggtaaaaggtctgtgctccacctgagggctcagctgattgcaccaccgtagcctgcacgat

SEQ ID NO: 1577 - DNA, 463 bp, Pinus radiata
gtgaaacttgagcaatttaacttgattctgtggagactgatgctgatgagaaaattgaggacaagggaggaagcttgaaaatgactcgccaccagaaacgcaaaattgatgaaatccacgttgaagagggtcagggtcatgaggattttgatcctgctagccttcgagagcatgaggagtttacgaaagttaagaacatagcaaaggtagagcttgggaggtatgagattgagacgtggtacttttcacctttccctcctgaatacagccattgtgagaagttattcttttgcgaattttgtctcaatttcatgaagaggaaagaacagcttcaaagacatatgaggaagtgtgatctgaagcatccacctggagatgaaatatatcgcaatggaaccctctccatgtttgaggttgatggaaagaagaacaagatatatgggcagaacctctgctatctggc

SEQ ID NO: 1578 - DNA, 343 bp, Pinus radiata
  misc_feature (1)...(343): n = A,T,C or G
gaaacaccaaggttgggatntctagaacgaagcatacgacaacagcgcgcatttcaccacttaggattgatggagcagcacccttggcgaccgcagagaggacttcctgaacgctctgtntctgttcttcgtgcatggttgtttgagcattttctgcacccgtatccaactgatgcagataagcatatattggctaagcaaactggccttacaagaagtcaggtatcaaattggtttataaatgccagggttagactatggaagcccatggtggaggagatgtacatggaagaactcaaggaagaaaaagtggaccaaggtacacacaattctgaagctgaaa

SEQ ID NO: 1579 - DNA, 530 bp, Pinus radiata
cggcaagtggggagtgccggacaatttgtatggagctcaggaagacagtggtggaagtagtgttaaacagaagaacttgaaggatggggaccaattcaccagtagtgatgaagctgacagtgaggtcaatgaattcaacattatgaaaagaagcaattcaggggttggatatgaagataacaaaagaagtggggggcaaggtgatggcaatcagtacaggtcacgtcactctcggagcatctccatggatagcattatgagtaagatgcataacttcagtgaagacttggaacaggaaccgtctcaaggtcggaatgtcagacactcccatagcaattcgatggatggaagtacaaatttcaatgtggaattcgggaatggggaattcagtgcatctgagatgaagaagatcatggccagtgagaaactggcagagcttgcaacggtggatccaaaacgtgtcaaaaaggatattggctaatcgccagtcggctgcacgctccaaggaaagaaagatgcgctatatctca

SEQ ID NO: 1580 - DNA, 561 bp, Pinus radiata
ctccactaactccttcatttcaacactcacagcatcggatccgtgcgataaaacttctatactggttcgatctctcagcccaacagccgtaggccgaccgccattatcgtcctctaagaaagcttgcatccatggaaaacctgacgatctctcaggaaagtgtaacactacaggcggacgctgccactgctcttcaaaacgcaagaagtccagagtgaaaagaactatcagagtacctgcagtcagtgcaaaattggcggacattccatctgatgaattctcatggcgaaaatatggacagaagcccattaagggctctccacatccaagaggctattacaaatgcagcacagtgagaggttgccctgcaagaaagcacgtagaacgcgccctggacgatccaaacgtattgattgtaacatatgagggcgaacacagccattctcattctggatctgaaaacacaggcctggtactggattcgtgagacccacatacagacaaagacattattctagttttatattacgctacagaatccgccattattacagcgggatg

SEQ ID NO: 1581 - DNA, 357 bp, Pinus radiata
cccagaacggcataagcactgacaaaggattttaagatctgtgcgatgtgggatatggatttgccttcccaagggtcaagtttgagttcatctggttcagtttggactatacaacagaacaaaatttttgaaaatgctctagctgattttgataaagacaccccagataaatgggagaaagtggcagccaggctgcctggaaaaactgctacggatgttagaaagcattatgaagatctcgtggaagatgttacttgtattgaagctgccgcgttgccctacccacgtacagtaactcttcctgttcacatgaatggttagaaaaatcaggcgctatgcacggattgaagcaacaat

SEQ ID NO: 1582 - DNA, 522 bp, Pinus radiata
gcgagctaggcggtacgtaagcaggagagagatttattttcttgtgtttcagagtttttgcagtgcgtctaaatggcggtagaaaccatgcggatgtcgagggtgagactaggaagttgcgaggacgaatcccgggccgtcaaagaaacccatttcaggggcgtgcgaaaacggccgtgggggagattcgcagcggaaatcagagatccatggaagaagactcgagtgtggctgggcacattcgacactgccgaggaagccgcccgtgcttacgatactgccgccaggagattgcgcggccacaaagctaagaccaatttttctgtcaccgccgactaccacaataacgctggtgcgcccgcactttcctggactcaggcgctgcatcctcagcagccggatctgaacgccgcggcttttgctttcgtatcaaacaagagacgtgaagtttcctctggaagcgaccggctcgagttcgaatctcccaacaattctcttcacgctgcacctctgagcaggcgg

SEQ ID NO: 1583 - DNA, 530 bp, Pinus radiata
ggcaggagttcccgcaagctttaagaacccttccctttgtgttagacctccaggttcctcaggtacgcagtctctacatcgcgtgacgttcaagggagacgggatattcagagtccgatcgccgccatggccgtagacaccatacagatggcgagagtgggtgtaaaaatgaagatcggaggaggcggctgcgaggaagaggcgtcctcggctgtgaaggaaacgcatttcagaggagtgaggaaaaggccgtgggggagattcgctgccgagatcagagatcccttgaagaaaaccagagtctggctgggcacttttgacactgcagaggaggccgcccgagcctacgataacgctgccagaaatctccgcggggccaaggcgaaaactaattttcttctgtctccccacaatgacattagcaccaagggcagcagcagcgccgccctgtcgagcaatagcaccaccagcgccgcctctggtcaaatccaaaaccaatggcccctgcggccatatttctattcgaatca

SEQ ID NO: 1584 - DNA, 435 bp, Pinus radiata
gcattgctctgctcgaacacatagtagtctgatctctgcgcttcgagcactacgagaattgcttcaccattaccttcatcatccaccaatggcggccgaagattttaatgacaagaatgctgtattcagaaagctccgggccaaacccgacaacaagatgtgctttgactgtaatacaaggaatcccacatgggcatcggtcacttacgggattttcatctgcctggattgttctgcatctcatcgtagtcttggtgttcacattagctttgtcagatctgtaaacctggactcatggactcctgaacagttgaaggtcatgagctttggtggcaatggccgaggacatacattctttaagcagcatggttggaatgatggaggtaaaatagaatcgaaatacacatcaagagcagctgagctatatagacagct

SEQ ID NO: 1585 - DNA, 362 bp, Pinus radiata
gaaagacttgcagcttacatggtggagggtcttgctgcacgaatagcatcttcaggaaacggaatatacaaagctttgaattgtaaagcgccaccaagcactgatactttatctgccatgcaaatattatttgaagtttgcccatatttcaaatttggttgcatggtggccaatggtgcaatttgtgaagccttcaaggatgagcagaaggttcatatactagattttgaaattgggcagggaagtcagtacataagcctcttaaatgtccttgcagaaaggcctggtgggcctccacatttgcgcataactgcagtagatgattctgaagatgtaagatatattcctgggggattggataa

SEQ ID NO: 1586 - DNA, 362 bp, Pinus radiata
caggagccgaaaagacaaactacgaacaaaatccctgtccaaataacaagaaaaatggcagagtcacaggggtcgtctacacattacaaaccgtacaggcagaagcagactctctcaggccaccgtggagcggtctcgtgcgtgaaattctcaaaggacgggcgtctcctgggcagcgcttctctggacaaaacaatatgcatatggtcggcctctgcttcttcttctacctctgcattcaagcgggagctccacggccacagcgagggcgtctccgacttcgcgtggtcgtccgactcccgctatatctgctcggcttctgacgacaagagcctccgcatctgggacgtccacacgggcga

SEQ ID NO: 1587 - DNA, 389 bp, Pinus radiata
cttcggtctgcctgggtgcgtttctgaatttctcgccaagtgagtgagtcgatccagccttgtttcagcgaaacctgttgtggttttgggttttcttggcttttgccttttcattctttgtttccttggattcgaactcgagatctcctgaatattatggcacaggagagctggaaccaggaggagaccgggtgccaagtcccggaagggctcatgcgctgtgccaacaactgtggcttcttcggaagtccggccaccatgagtctctgctccaagtgttaccgcgaattcgtgctgctcaactcccctaaatcgtccttcgataagccgcaacagcagctgccgatgcaggacgaggtatctatcccgagacccgacgttgctgctga

SEQ ID NO: 1588 - DNA, 416 bp, Pinus radiata
  misc_feature (1)...(416): n = A,T,C or G
cagcaatggcggcccagactatcatcgctgcctctatggcatctcctctaacattatcaaatggccactatccgtttnagtccgagttcaaggggtccgtggttcgaatcccgcagagggcattttccttcgcgcctgcagcccgggcgctgaccgtcgtcgcataggccaagaaggccgttgccgcgctcaaagggaattcacaggtcgagggtgttgtcagtctctcgcaggaagacaggggtcccacaacagtgaaggtccgtttgacaggactgactcctgggaagcatggctttcatctacatgagtttggtgacacaaccaatggctgcatatcaacaggagcacattttaatccaaaaaaattgacacatggtgctcctgaggatgatgtacgccatgcgggtgacctg

SEQ ID NO: 1589 - DNA, 507 bp, Pinus radiata
tgcgagtcaatgttctaatgatcccatttgtcacacatgcggcaaatctggtcacctctccagggattgtacggctccagagcttccccctggagacattaggctttgcaacaattgttacaaacaaggacatatagctgccgagtgtacgaatgagaaggcatgcaacaactgtcgcaagaccgggcatcttgctcgtgactgcaccaacaacccagtttgtaatttgtgcaatatatctggtcatgtggccagggagtgccccaaggctcgcattttggatggtaataggggtggaagatttattgacgataggcgtggaagatttaatgacataatctgtaggacatgcaacgagccagggcataccagtagggagtgcactggaattctcatctgccacaactgtggtggccgtggacatgttgcatacgaatgcccctctggtcgtgtgatgctgcgggacatgcgcaggcattgatgctgcagtttctacaccacctgact

SEQ ID NO: 1590 - DNA, 370 bp, Pinus radiata
cgatattttatgttgttgaagttggcaaaaggagcattggtcttaaaaggtcaaccctgtaaggtcctgatcaaccctttgacaagataaaaatggacagaaattcagaattttatgaagagacatcgtcacagaaaaatcaggcatccggatcaagtgatggaggtagttttgattgcaatatttgcttagaattagcccaagatcctgtggtgactcaatgtggtcatcttttttgttggccttgcctataccaatggctacagatgcactccatatcaaaagaatgccctgtttgcaagggcggtgtagttgaagagaaggtaattcctttatatgggaggggtaaggtgggttctgctgatccaag

SEQ ID NO: 1591 - DNA, 308 bp, Pinus radiata
gttcccaggagaggagagcctcagctgtctcgatctggcgttaaggggttacagaagaagaatttcgaagatggttagatcttcttgctattcaaagcaaggtcataggcgtgggatttggacccctatggaggatatgattctctctgaatacattcgaattcatggcagtgatggatggaaaaatatcgctaaacgagcaggtcttaaacgatgtggaaagagttgcagattacgttggttgaactatcttcgccccgacattaaacgtggtaacatttctcctgatgaggaggacctcattatta

SEQ ID NO: 1592 - DNA, 361 bp, Pinus radiata
ggatattctggtgtgcattgctattctggccatgaattttggcagaatgtgcgattagggtttgattctgggtgttcttttcaggtacagcagagatttgaaggggatttgaatttgaatcatggaagttgagtgctgcagccctcggtcttccgctcaggggtgtgaggttgacatgaagccaacgatggtggtggaagatacgcttaatcaaggatgcatgcaatatggatgttcacactaccgccggagatgccaaataagggctccgtgttgtaatgaagtctttgactgtaggcattgtcataatgaggccaaaaattcaatggatgtccatccacttgacagacatgatgtaccg

SEQ ID NO: 1593 - DNA, 378 bp, Pinus radiata
  misc_feature (1)...(378): n = A,T,C or G
accaagctcatcacatggcgtccgagaaggaagctgctcttgctgccacaccaccagaagatgataaacctacaatatttgacaaaatactgcagaaggagattcccagtacagtggtttacgaggatgagaaggtacttgcattcagggatatcgcaccccaagcacctactcacatcattatcatccccaaagtaagggatggcttgactggcctatctnaggcagaagagaggcatgaggatattctaggtcacctgctatacactgcaaaagttattgcaaagcaggaaggtttatctgatggcttcagaattgtcattaacgatggtcctactggatgccaatctgtgtaccatttacatattcatctactcg

SEQ ID NO: 1594 - DNA, 333 bp, Pinus radiata
gattgacggatcgattgcaatggcgtttgcggaagagtattccgatcgcgatgccgtatttcgaaagctgaaggcgaagtctgaaaacaagatttgttttgattgcaatgctaaaagtcccagttgggcgtccgtgacatatggagtattcatttgtcttgattgttcagcaatgcatcggagtcttggtgttcatgtcagttttgtgaggtctacaaatctcgatacatggaccatggagcagttgaaattgatgagctttggtggtaatggccgtgcacaattattctttaagcaacatggttggactgaaggtgggaagattgaatcaaa

SEQ ID NO: 1595 - DNA, 356 bp, Pinus radiata
ccttaacgttgtctatgtgttgatatatatcacaagtgccgtctatcgcctccttcggttcctggggttccgagagtttgtggaacccgagacctcctggccagatgaaatcaacccacggttgaagcccgtgacattttccgtatctgcgcagaggattcgtgagcgattaccagtagttcggttcggcgttttagcggaggaggccggtgatgaggatgttatgtgcgctgtttgcttaaataacatgcagaggcatgaggagatccgaaggctaacgaattgccgtcacatcttccacagagactgtatggacaaatgggttgatcatgaccagaacgcctgtcctctctgca

SEQ ID NO: 1596 - DNA, 378 bp, Pinus radiata
  misc_feature (1)...(378): n = A,T,C or G
gtcaacgagaattgccacgatgggttaatgtggatttaggtctgggaagctttaggataagttaatgtaccgaagtgtggttaattttagtaaagaggattgtgttttatcatgcggatccagtgcgatgcctgcgagcaggcagctgcttcagtgatatgttgtgcagacnaggctgctttgtgcagggagtgtgatataaaagtccacaaggccaacaagcttgccagcaaacacaagagattgcctcttgtcggaacttccccaaagctctctcgctgcgacatttgccaggatagggcagccatcgttttctgtctcgaagatcgtgctatgctgtgccaagactgcgatgagtccgttcattctcgcgacaca

SEQ ID NO: 1597 - DNA, 387 bp, Pinus radiata
tcgataatagcagggagagtccccggccgaacagacaacgaaataaagaactactggaacactaacttgagcaagaaacttgctgtcaggggaatcgatcccaagactcataaaaaaatcacgacggacggcacgaacagagtcaacggtgatcgtttcagccagaggaaaggtgagaaaatatatgattctccacagaaacctcgacagccggaaagaaatgttgcgagggccgcccaatcaacagggctcgtgattcctaatgttcacaatctaaaagcggatttaaaagcgcaatatattgcaagaatcagagaatttaaaagctctaatactatcagctcctcttctcgacttaatgcacagattgagccaaagtccagagag

SEQ ID NO: 1598 - DNA, 276 bp, Pinus radiata
ggtttgtcagatttggtgacgagaatgagaaaaaccgagccatgactgaaatgaatggtgtttattgctcttcaagacctatgcgaattaatgaagctacaccaaagaagtccttgggatttcaacaaccttattccatgaaaggtaactattacacacaggcatatggtggtgcagttgctagtcaggccttccagtcagacaatgatccaaataatacaactatatttgttggtgggttagatccaaatgcgacagatgaagatctgaggcagg

SEQ ID NO: 1599 - DNA, 374 bp, Pinus radiata
  misc_feature (1)...(374): n = A,T,C or G
cacatcttgagcgaataaaaaatctacgtgatggtggagctggtgctgaagacagcgacnaaaaggatgaagactttgttgcagaaaacgatgatgctggatctccaacagatgagtcagaagaagagggatcagatgcaagtgagagtgcagaggtcaagcaacctgcaaagaaagaagtaaagaaaaaaaaggcggtggctcccaaggcaaccgagaccaagaagaagaagaaggacgacgaggaagagggaggaaagaaaaagcagcggcgaaagaagaaggatccaaatgcgccaaagaaagccatgactggatttatgttcttttctcaagttgaaagagagaatctgaaaaagagtgacccaagaatg

SEQ ID NO: 1600 - DNA, 334 bp, Pinus radiata
gatctgtgttgctgtttgattccgcaagcttggggagatcaggatctgctctttgttgtaaatgtcgatattacccaaatcagattccattcatattagggaagtatgggccgataatctggaagaggagtttaatctgatcagggaaattgttgatgactaccctctgatagccatggacacagagttccctggcatagttgtgcgacccgtgggcaaattcaggaccgtccaagaatacaattatgaaaccctaaggtcaaatgtagacgtattgaaattaatacaattggggctgacgttttctgatgaaacggcaacctcccaaactgcg

SEQ ID NO: 1601 - DNA, 401 bp, Pinus radiata
  misc_feature (1)...(401): n = A,T,C or G
gttaggccagctcttagttcgagtccgggccgctgctcttaatcctgccgactttaagagacggaaaggcttattaagaaacgcggattccgattttccgactgtgccaggctgtgatatgtcaggagtggtggtggaaattggtgatggtgtctccaagttcaaggccggtgacgagatatacagcaacatccagaatttcgcagcagggaggccaaagcagtgcgggactctcgcccagtacacagtggtggaggaattcctggtagcgccgaagcccagtaatttatcatttgaggaagccgcgagcctgccgcttgcgcttcagactgcgcagcagggcttcgatacaaccaattttgaaaaggggcagagcgtgttcgttgtgggaggctcggncg

SEQ ID NO: 1602 - DNA, 462 bp, Pinus radiata
ggtttgtcagatttggtgacgagaatgagaaaaaccgagccatgactgaaatgaatggtgtttattgctcttcaagacctatgcgaattaatgaagctacaccaaagaagtccttgggatttcaacaaccttattccatgaaaggtaactattacacacaggcatatggtggtgcagttgctagtcaggccttccagtcagacaatgatccaaataatacaactatatttgttggtgggttagatccaaatgcgacagatgaagatctgaggcaggtttttgggccatatggagagattgtgtatgtgaaaataccagtgggcaaaggatgtggttttgtacaattcaccaacaggtcctctgccgaggaagctttgcaaagttacacggcactgttattggtcaacaatctattcgcctttcttggggtcgatctccagcaaacaagcagactgcaagctg

SEQ ID NO: 1603 - DNA, 358 bp, Pinus radiata
cagcgaagccgatttccaaagatggatagggagaaactcatgaagatggctggtgcagtccgcactggcggaaagggtacaatgcgaaggaaaaagaagacaattcataagactgccacggcagatgacaagagacttcaaagtaccttgaaaagaataggcgtgaataacatccctgctattgaagaagtcaatatttttaaggatgaccatgttattcattttgctaacccaaaggtccaggcttctattgctgccaacacatgggtggttagtgggtcatcgcaaacaaaaaaacttcaagatcttttccctggtatcatcaatcagcttggaccagagagttttgccaatctga

SEQ ID NO: 1604 - DNA, 358 bp, Pinus radiata
accaagctcatcacatggcgtccgagaaggaagctgctcttgctgccacaccaccagaagatgataaacctacaatatttgacaaaatactgcagaaggagattcccagtacagtggtttacgaggatgagaaggtacttgcattcagggatatcgcaccccaagcacctactcacatcattatcatccccaaagtaagggatggcttgactggcctatctaaggcagaagagaggcatgaggatattctaggtcacctgctatacactgcaaaagttattgcaaagcaggaaggtttatctgatggcttcagaattgtcattaacgatggtcctactggatgccaatctgtgtacca

SEQ ID NO: 1605 - DNA, 461 bp, Pinus radiata
gcggactttattgtaaaagagccaatggtgattggtcatgagtctgctggaataattgaggaggttggcagtgaagtgaaacatctggttcctggtgaccgcgtagctttggagcctggaatatcgtgttggcgttgtgaccaatgtaagcgaggctcctacaatttgtgtcccgagatgaagttttttgcaacacctcccgtgcatggttccttggccaatcagattgttcatcctgcagatttatgtttcaagttgccagataatgtaagtctcgaggaaggtgccatgtgtgaaccactcagtgttggggttcatgcttgtcgccgtgcttctgtaggtcctgagacaaatgtcttggtaatggggcaggtcctatcggccttgtcaccgtgctgtctgcacgtgcatttggagcttcacgaattattattgctgatgtagatgaagagcgtctgtca

SEQ ID NO: 1606 - DNA, 463 bp, Pinus radiata
gccactgtttgtatgtgatctccgggccttgagcttatacgtttttcagttgcaggtttggagcctgtcaaattatacttaccatgatttggaaagaagctgcgacagtgctacacaaggcccaacatctggagaagccacccttcatctttactgtatttatcgcatcttttataggattcgccgccttctcgtatctcatcactaaccgtagaactagggaattacgaggaatcccgcccggcacctttggatggcctttgatcggcgagacattagaatttctgggatgccagagaaggggaaggccccaggatttctgtgaccgtcgaacacagaagtatggaaacgtgttcaccacttcccttgtgggcacccgacagtggtattatgtagtccccaaggcaaccgcttcttgttcgccaacgagaacaaactggtggtaaattcatggcccgcctct

SEQ ID NO: 1607 - DNA, 410 bp, Pinus radiata
tcctgactttgctaatgagacattcggcccaagcttagtcgttgttatcgctgccctgttcctctcaatgctatgctttttgttgttcaatgccctgctccgctgcagacggctctacaggcgatggcgagtggtgtcggagccatcacccaatatggatgtcgaaagaactgaatctggcatcgagaaaaaggatttagaagcactttcagccacagtttaccgcaaagcccaccccctcagagccatggattgccccatttgcctggcggaattcaaagaaggagaaaaggtgagagtattaccagaatgctgtcactgtttccatgcagattgcatagacgcatggctgctttccaatgcttcttgtccttcatgtcgacacactgtcctttgcgcattgccgaaga

SEQ ID NO: 1608 - DNA, 357 bp, Pinus radiata
taataattgggtactgtggagattttcctgtgcattgaccattacaatggctgagacagtggttttgaaggttggcatgtcttgcgaaggttgtgttggagctgtaaaacgagttctcaataaaatggaaggtgtggaaacatatgatgtgaacttgaaggagcaaaaagtaactgtgaaagggaacgtgaagcctgatgccgttctgcaaactgtttcaaaaactggaaaggaaacatccttctggccagaagagaaggatgccaccacgtgatggtgcatattctcaggtttaatatagatatggacatatattgaacatgcttttttgaggcacttttaataatatttctaata

SEQ ID NO: 1609 - DNA, 222 bp, Pinus radiata
ccaagaacgcgggaaggaagaggatgaatttgtacagaggcatcagacagcgtccatggggaaaatgggctgcggagattcgagatcccagaaagggggttagggtttggcttggaacgtttaacacggccggaggaagctgccagggcctatgacgcagaggcttagaagattagaggaaagaaagctaagcttaactttaccgatgattcatgctcagta

SEQ ID NO: 1610 - DNA, 302 bp, Pinus radiata
  misc_feature (1)...(302): n = A,T,C or G
gttcagcctatggttgtctgctaaatcgcttccacaaatgtcgatccatctggagagacctcttataactgaaatacaagtgcgtatggactgtaatggctgcgttcagaagatacgcagagctctgcaaactcttcaaggcatttatgacgtttacatanatttcccccaacaaaaggtgacagtggtaggatgggttgatccagacctattaatgaaggccataaagaaagccgggaaaagagccaaactgtgcagccacgtacgcgatgaagaaacggtcgagagagccgacccggcgg

SEQ ID NO: 1611 - DNA, 268 bp, Pinus radiata
gaatgaagttagatacggcaaagaaaggccttcctccaggcaccatgggatggcctctctttggagaaactcctgattttctcagatatggtcaacaatttatcaaaaacagaaaggccagatatggagatttgttcaagactcacattctaggatgcccgacggtgatatcgacggatccagctctcaacagatatatcttattgaatgaaggccgaggactaattcctggatacccgcagtctatgcttgacacattgggaaaatg

SEQ ID NO: 1612 - DNA, 312 bp, Pinus radiata
gctcactggaataaacactcttcgcatccagcccttcaaacttcccctcttggcccccatgatgcgaaggtgcgcatgaaggctgtgggtatctgtggcagtgacgtccactatttgaggacattacggtgtgcggactttattgtaaaagagccaatggtgattggtcatgagtctgctggaataattgaggaggttggcagtgaagtgaaacatctggttcctggtgaccgcgtagctttggagcctggaatatcgtgttggcgttgtgaccaatgtaagcgaggctcctacaatttgtgtcccgagatg

SEQ ID NO: 1613 - DNA, 324 bp, Pinus radiata
gctggctacagcttatgccttccgattcgtgggtgaatggatgaaatggctatacttggatgtaacaaaacgtttgggagcaaaggatttctcaacattggctgaagcacatgcatgtactgctgggttaaagtcattgacaacatcagtgactgcggatggcattgaagattgtcgtaagctttgtggtggacatgggtacttgtgcagtagtgggcttccagagctgtttgctgtatatgttcctgcgtgcacatatgaaggagataacacagttctgcttctacaggtagcaagattcttgatgaagacagtccaacaact

SEQ ID NO: 1614 - DNA, 395 bp, Pinus radiata
  misc_feature (1)...(395): n = A,T,C or G
gttcccaggagaggagagcctcagctgtctcgatctggcgttaaggggttacngaagaagaatttcgaagatggttagatcttcttgctattcaaagcaaggtcataggcgtgggatttggacccctatggaggatatgattctctctgaatacattcgaattcatggcagtgatggatggaaaaatatcgctaaacgagcaggtcttaaacgatgtggaaagagttgcagattaccgttggttgaactatcttcgccccgacattaaacgtggtaacatttctcctgatgaggaggacctcattattaggttgcatggccttcttggcaatcgcaggacgactaccgggtcgaacagacaacgaaatcaagaattactggcacactcatatgag

SEQ ID NO: 1615 - DNA, 231 bp, Pinus radiata
  misc_feature (1)...(231): n = A,T,C or G
ttacattcaaccaagctcatcacatggcgtccganaaggaagctgctcttgctgccacaccaccagaagatgataaacctacaatatttgacnaaatactgcngaaagagattcccaatncagnggtttacaaggatgagaaggtacttncnttcagggatatngcnccccaagcacctactcacatcattatcatccccaaagtaagggatggcttgactggcctatcta

SEQ ID NO: 1616 - DNA, 396 bp, Pinus radiata
ccggtccgggcggtggagagcatcagccttggagttacagaccaggaaaatacaagatgggtagatctccttgctgctccaaagaggggctcaaccgcggggcctggaccaaaagggaggatatgattctctccgaatacgttcgaattcatggcgatggtggatggagaaatcttccggaaaaagcaggtcttaagagatgtggaaagagttgcagactacgctggtttaactatcttcgtcccgatattaaacgcggaaacatttgccccgccgaggaggagcttattattcggctgcatcgccttcttggcaatcggtggtcactgatagcaggacgactgcctggtcgaacagacaacgaaatcaagaactactggaacactcatcttgagc

SEQ ID NO: 1617 - DNA, 296 bp, Pinus radiata
  misc_feature (1)...(296): n = A,T,C or G
gtcggcgtcggcggcggctgcgaggaaacggcggcgtcagctgtgaaggaaacgcatttcanaggcgtgaggaagaggccgtgggggagattcgctgcggaaatcagagatccctggaagaagacgagactctggctcggcacttttgacacagccgaagaggccgcccgcgcctatgataatgccgccagaaatctacgcggccccaaggccaaaaccaatttcgctatccacgacgatagcgcccgccctgttcaacagtggcggcggacgcgccgtccctagtcagcgacaag

SEQ ID NO: 1618 - DNA, 381 bp, Pinus radiata
gagctttctctcaagaacattcttacagcaaatgagcagactacaactgcagaacccagaaataataatacagttgttttcctggaatctattactaatccatctgtcagagttgcggatttaccgtctatttccactgtatgtaaaaagtatggagcatttcttatagtagataatacatttgctacaccgataaggatcaagcccatcaagcagggtgctgacatggtcattcattcagtaacgaaatttcttggtggccatagtgatctggttgcaggagtagttgcaggctcttctcaccacatagagttagcctcaaagctggtaggtcgctgggggctgcttgctgctccattcgattcatggcttgccactcgc

SEQ ID NO: 1619 - DNA, 373 bp, Pinus radiata
cggtccatgtgacttcgacatccatgagtcctgcgcccaagctcctaacgccactctccattcctgtcatccccagcatcctctcgtgttgagggacaaaccagtttcaccacaacgcgtatgcgacgtctgtggaagggatgttttaggattcgtttatgactgccgtgaatgtgacgtggacgttcatccctcctgtgcacagctgccgcagacgctgcgccacgctctgcatccacaccacacccttcaactctcccatggacctgaagctcccgcccctcctgcacgctcctgtaacgtatgcggagaagcctgtagccctgggcactggagctatcgttgcgaattagccagtgcgccgtgtgatttc

SEQ ID NO: 1620 - DNA, 137 bp, Pinus radiata
cacgggttccagaccttttgcatcttcattattcttccgcctgtgaaaagatggggagatctccgtgctgtgagaaggctcatactaacaaaggggcctggactaaacaagaagatgaccgccttatcgctcacatt

SEQ ID NO: 1621 - DNA, 372 bp, Pinus radiata
gttcccaggagaggagagcctcagctgtctcgatctggcgttaaggggttacagaagaagaatttcgaagatggttagatcttcttgctattcaaagcaaggtcataggcgtgggatttggacccctatggaggatatgattctctctgaatacattcgaattcatggcagtgatggatggaaaaatatcgctaaacgagcaggtcttaaacgatgtggaaagagttgcagattacgttggttgaactatcttcgccccgacattaaacgtggtaacatttctcctgatgaggaggacctcattattaggttgcatggccttcttggcaatcgcaggacgactaccgggtcgaacagacaacgaaatcaaag

SEQ ID NO: 1622 - DNA, 464 bp, Pinus radiata
ctgaattgcatttcttagtcggcaaaaatattaaagagtcaagacaaagagggggttacgggagcaggctgcgggttcgatcccaagataaggaaaaaagaaagaaaatttcatgaattgggcctgtagattccagtcacgaaattaaaacctatcggtctcgtcttcgagctaaagttggggaaaaagctaagctctcagggaatgggttcccgcacaatgctgtcctctaatggtggccggacacctcagttccaaccactcgttcgtcagaattctttatacaatttaacgctggaggaggtccagaaccagctcggggacgccagcaagccacttagcagcatgaacatggacgagctcctgaagaacatttggacacaagagaaagccaggctatatccatggcgatcggcaatgggcccatgaacggtgttcctcccaactctgcccctgccagcggt

SEQ ID NO: 1623 - DNA, 436 bp, Pinus radiata
aagaaaaatgggctgaatagtctcagggagggttttaaattgaatgagtaggtttttctggggtgagattctttcatatttatgcgtaaaacgttgactccaatcggcgtgaaacaaaccaatagaaatcccaaattgatttctttcaatttcatctgatacacagagagaattcagtcagtggaagtcatgtctaacataacgtctgcctctggagaggccagcgtttcttctggcaatacagctgccatggctgatagtgagagcattcggcaacagccaccacaacaattctcaacaccaacgtctgcaaatggcgccggaaatataaacagtgctcagcaaaacccagagaagaagagaaagagaaatcttccaggaactccagacccagatgcagaagtgattgctctgtcgcctaggactctcatggcta

SEQ ID NO: 1624 - DNA, 337 bp, Pinus radiata
gccagagctgtggctgttcccagaagaggatatcatcagctgtccagtttgtcctaagagactacagaagaagaatatagaagatgggtagatccccttgccccccaaaagaagcgcttaaccgtggggcttggacaggcatggaggatacgattctcaccgagtacattcgagttcatggcagtggtggctggaaagatatctccaaaagagcaggtcttaagaggtgtgcaaagagttgcagattgcgttggctgaactatcttcgtcccgatattaaacgtggtaacatttctcccgaggaagaagagctcattattcggttgcatcgccttct

SEQ ID NO: 1625 - DNA, 421 bp, Pinus radiata
ctgaagtgccgtcgattgttcgggaggatagcgttttcgaagttcgttgttgagttatctcgcgagactgtagaattttagggttgttttccacaaaccgacttttcccgacttcaaatcttgatattgaagtgacatggccggcgagaaaagaaagattaatagaatagctaacgcttcggccaggcaggtcaccttcgcgaagaggcggagggggctgttcaaaaaagctcaggagctatcgattttatgcgaagccgatgtagccctcctcgttttttcttcaactggaaagctgtaccagtactccagctccagcatgaaaatgatattggaccagtatattttgtattctagatcaattcaaaaggatggaaagccaaatctggaggagagtcacgatatccaaaagataaaccac

SEQ ID NO: 1626 - DNA, 315 bp, Pinus radiata; identical to SEQ ID NO: 515

SEQ ID NO: 1627 - DNA, 373 bp, Pinus radiata
cacatccatacatgtggggtggacagccgttgatgccaccttatgggactccactaccatatcctgcaatgtatccacatggaggaatctatgcacatccttccatgcctccgggtgcacttccgtatggtcactatggaatgccatcacctggcaatgctgaagttacaacgactttagcacttccaaatgctgaagcagaagccaagtcctcggaaggcaaagagcggaatacaatgaagagatcaaaaggaagtttaggaagccttggaatgattactggcaaaggaggagaaggtggcaaggcaacatcgggatctgcaaatgaggccatgtcacaaagtggggacagtggcagtgacggttcaagcga

SEQ ID NO: 1628 - DNA, 512 bp, Pinus radiata
cggtaatagcatagagggattatacagaggtggattgttattgaaacccagtagtggaggtagagtcttgacaagttgggacaaaggagggaattccacggatgttatagatatggatatagggactgggagactaacaggttctgaaaggagacatgacaaacggaatcctacatttacagaccattatagacattcagacagtgatcgaatgaagatgaacagctacttatatccagaaaacaacaatagcacggcgcttgttgcgtctctgtttgttcccaggaacgacaaacttgtaaagattgatggcaaccttataatccatgcagttctagctggggaaaaagcctcgagagcattatctgcctcacagtctagaggcaacaaagatgggcatgtagacaccatttcacttcaaaaggaatatgaaaagaatagtttggcagtcagaacagaaaggcatcgtgctcttgctgctgctgccgccgccactacagattcagccagaa

SEQ ID NO: 1629 - DNA, 395 bp, Pinus radiata
gagaaaacggacctgaccatatcgaaacattcacagggggagattgatcaaacacaaataccgtaaaatcgcagcgaaaatccaaaattccaccatggggactgtggcggaggatggcagcaagggttacaaggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcctgttgttgggcaacttcctagttgcttggatggagagttcgtgcgcgttggtcccaatccgaaattcgcaccggtagctggctatcactggtttgatg

SEQ ID NO: 1630 - DNA, 285 bp, Pinus radiata
ctctgcattttcttttggggaacttcgctccagtctcggaaactgcccccaaatcgcacctgcctgttgttgggcaacttcctagttgcttggatggagagttcgtgcgcgttggtcccaatccgaaattcgcaccggtagctggctatcactggtttgatggagatggaatgatccatggtctcagaattaaagatggtaaagccacatatgtgtcacgttatgtgaagacatcacgcttgaaacaagaggaatactttgggaaagcaaaattctttaagattg

SEQ ID NO: 1631 - DNA, 438 bp, Pinus radiata
gtttttcaaagctcaggtttaacagaaaatacccgggaaaattaacaagaaaaaaggaaaaacagagattttgtttatttctgttattagtctgctaaattggtttttgataatttaattaattaaggcgggggcccgcacctccaggcagtggcggagaccagtgggcggccctgccacccgaggaggagagccgcgtgcgctttctcgacttcgaacccgcggctatggaggcgctggatcaggtactctgcctgcgtctcggtgaagttgctgaaggccactggggagaagccggcggcggcgaacagggtcttccatggcggagccggcggcggaggaaatggtggcgtcgatcttcggagctagcaggaacttctcgatcttgtgcacggcctccatgttgatgttcacggcatccagtgaatcgaacaggaa

SEQ ID NO: 1632 - DNA, 457 bp, Pinus radiata
ccatatcgaaacattcacagggggagattgatcaaacacaaataccgtaaaatcgcagcgaaaatccaaaattccaccatggggactgtggcggaggatggcagcaagggttacaaggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcctgttgttgggcaacttcctagttgcttggatggagagttcgtgcgcgttggtcccaatccgaaattcgcaccggtagctggctatcactggtttgatggagatggaatgatccatggtctcagaattaaagatggtaaagccacatatgtgtcacgttatgtgaagacatcacgct

SEQ ID NO: 1633 - DNA, 318 bp, Pinus radiata
aattgttgataatcagattccattgagtggacctgattcagttattggtagggcacttgttgtccatgagttagaggatgacctggggaaaggtgggcatgaacttagtctgacaactggcaatgctgggggcaggttggcttgtggtgtggttggactcactcccatttaaggcccagtcaaatatggaatgatcttcaaaggtcatggacatcgtatgaaaccagtgactgcaataataattccaaaatatatgttctttatcctcgcaagattgttagcaattgtgatttgtttttggtattaacgagttgcact

SEQ ID NO: 1634 - DNA, 211 bp, Pinus radiata
gccgtggctgttcccaggagaggagagcctcagctgtctcgatctggcgttaaggggttacagaagaagaatttcgaagatggttagatcttcttgctattcaaagcaaggtcataggcgtgggatttggacccctatggaggatatgattctctctgaatacattcgaattcatggcagtgatggatggaaaaatatcgcttaacgagca

SEQ ID NO: 1635 - DNA, 350 bp, Pinus radiata; identical to SEQ ID NO: 530

SEQ ID NO: 1636 - DNA, 356 bp, Pinus radiata
ggttgctggattccaacggaaaggatttgcctctttcatcagtctataatcgaggatctctgcagtcctttactagtgaaggtcattccgtttcaacagtaatcctccgtattgaaaaggaggaagaagagtttgtctttgttgacattcctgaaagaccaattccctctctactacgcaattatagtgctcctgtgcgtcttgtttcagatatcactgatgatgatttgtactttctacttgcacatgattcagatgagtttaaccggtgggaggctggccagacattggcaagaaaactcatgctctctctcgtagataaggcgcaacagaatcaaccattgagtgtggaccca

SEQ ID NO: 1637 - DNA, 362 bp, Pinus radiata
cgaggctccgttcaacccctttcatcttcaatcgttccaaggcctcttcggtctgcctgggtgcgtttctgaatttctcgccaagtgagtgagtcgatccagccttgtttcagcgaaacctgttgtggttttgggttttcttggcttttgccttttcattctttgtttccttggattcgaactcgagatctcctgaatattatggcacaggagagctggaaccaggaggagaccgggtgccaagtcccggaagggctcatgcgctgtgccaacaactgtggcttcttcggaagtccggccaccatgagtctctgctccaagtgttaccgcgaattcgtgctgctcaactcccctaaatcgtc

SEQ ID NO: 1638 - DNA, 359 bp, Pinus radiata
cgaaactcgaatcgatatgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggaggacgcgtcgctgcagaggcttgttcagaaatacgggccgaggaactggaccctgataagtaaaggaatcccggggcgatccgggaaatcgtgcaggctacggtggtgca

SEQ ID NO: 1639 - DNA, 299 bp, Pinus radiata; identical to SEQ ID NO: 525

SEQ ID NO: 1640 - DNA, 300 bp, Pinus radiata
gaaactatgaaccgcgcataaaatcgaaggcgaggagtgctagaagaggcggtgaagttgaagttgttatggggggaattatgctggtcgggtcgacgatgattcctgcgggcggcgcggcggcagcggcggagacgtcggtggaggaaggaggagaattgaataagatcgaaagccctacaccatcaccaagtccagagaaagctggactgagcaggagcacaacaaatttctgcgaagctatgcagcctgtttgatagggactggaagaagaattgaagcatttggttggttcacaag

SEQ ID NO: 1641 - DNA, 311 bp, Pinus radiata
gttcagctgttcgcaaagcacggagcgaaagtcataatcgcagacgttgcagagaaagctggcagaaagcttgcagaatccctttctccagcatcggcaacttatgtgcactgtgatgtcagcaaagaagaagacgtgagcgcggctgtggatctggctatggataagtatggtcaactcgacattatgtataacaacgctggaactaacgacagctttctggtgaagagcgtggcagagtatgatatggagcaattcgatcgagtgatgaacgtaaacctgaaaggagtgatgcacggcattaagcacgc

SEQ ID NO: 1642 - DNA, 350 bp, Pinus radiata
agggatcaggcaacgtccatgggggaaatgggctgcagagatcagggatcccagaaaaggcgctagggtttggctgggtacctttaatacggcggaggaagctgctcgggcttatgatgcagctgcacgaaagatcagaggtaagaaggcgaaagtaaattttgttgatgagccaccaccctccgttaagaaggaaagtaataatgctaagggttccaagaaagggtccagcaagaaaataaaatcatatctaccccaaagcctgactttttcgaaggtttcaaaacggcgaacccttcgattgcccaatacaacttccatcagaaattcccaaaccctaactgtgatga

SEQ ID NO: 1643 - DNA, 322 bp, Pinus radiata
gacttttgctccgaactgttctgctgaaacaaaatccagtattgagctaggtttagaatcgggtttgctggtcatctgggagaggcgatccattcagcttcgcaggcccccgaagatggcgttcgccggcacaacccagaagtgcaaggcatgtgaaaagacggtctatttggttgatcaattgacagctgataattctgtttttcacaaatcctgtttccgctgccatcactgcaatggaactttaaagcttagcaactattcgtcgtttgagggagttctatattgcaaacctcattttgaccagctgtttaagagaaca

SEQ ID NO: 1644 - DNA, 345 bp, Pinus radiata
gccgaaactcgaatcgatatgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggggacgcgtcgctgcagaggcttgttcagaaatacgggccgaggaactggaccctgataagtaaaggaatcccggggcgatccgggaaatcgtgca

SEQ ID NO: 1645 - DNA, 508 bp, Pinus radiata
cgtgtcaaagcccaaacgacccgtttcaacgcttataacatattatgtgagtatcggagtggaaaggcagcaccgagaaacatatccgaggagaaagtatactcatatattaacgtaacggaaaatggaaataatgatgatcaaggcaaaggtattacagaggtccatcctcatcccaagaaaggcatcctttcatcggtaattgatttggccgagaaaatcgtggttcgctcgctctacggctccgccaaacctctgcactacctcgctggtaatttcgcaccggtcgaacaagaaactccgccgcacacagacttgtccgtcattggaaatctccctaaatgcttggatggagaatttgtgcgagtcggtcccaatcccagattttgcccccgtcgctggctatcattggttcgacggagaccggaatgctcatggtttgaggattaaagatggcaaagcagcttatgtttcgcgtttccgtcaaaacttcacgtctcaagcaaga

SEQ ID NO: 1646 - DNA, 368 bp, Pinus radiata
tggctcttcccggcagacctagtaagccgactactgtaaatttattcttttagggttacagaaaaagaaaatacaagatgggcagatctccttgctgctcaaaagaagggctcaaccgtggggcctggaccaaaagggaggatatgattctctccgaatacattcgaattcatggcgattgcggatggagaaatatgcccaaaagagcaggtcttaaacggtgtggaaagagctgcacgattacgatggctgaactatcttcgccccgacattaaacgtggaaacatttcccctgatgaggaggaactcataattcggctccatcgccttcttggcaatcgatggtcgcttatagcattgaagattac

SEQ ID NO: 1647 - DNA, 367 bp, Pinus radiata
  misc_feature (1)...(367): n = A,T,C or G
cttcccttcatcagatgtttcccaggctgcactcatcagctgcagcaccacgcggttttggattctccctgttctttgttctgttgcgttaaagattggttgcaggtcgaatcgcccaggccgatttgaattctcctgaggattgacaagatgacgcgcaagtgctcgcactgtggcaacaacgggcataactccaggacgtgccctaaccgcggcggggtgaagctcttcggcgttcggcttaccgatggcccgatcagaaagagcgctagtatggggaatttgatgatgatgtccaaccctagctctcccgctgacccctccnagccggcctctgccgcttctgctgccgcggcggcggcggcca

SEQ ID NO: 1648 - DNA, 511 bp, Pinus radiata
gtggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttggcaatcgatggtcgcttatagcaggaagattaccaggtcgaacagacaacgaaatcaagaactactggaacactcatatgagcaagaagctgcttccattgaacgaatctcaacccaagactttgcctgtccccaagaggaggtcgcaatctccttctcccctgcaaaatcgagtct

SEQ ID NO: 1649 - DNA, 364 bp, Pinus radiata
tgcgcctccatccgaccaaacaagtgggggacatgcatattgcaagtgtggagaacactgcagctgcaatccatgtaactgttcaaagattgacgagactgttagtgggaaatccttctgtaaatgtggagagaattgcgcctgtgaaacatgcacctgcagcagagctggaatatagcctagttgattgtttttctcagccagaacttaggattccatgaccactagtaataagatgcagtatcaatagcagctgatgtttatgtatgcagtaagtttataaaagagagtggttactttttggctttagtaatttggtgcttatgttatgtatgtagtaagtttatctccaaatacagagccg

SEQ ID NO: 1650 - DNA, 354 bp, Pinus radiata
caagagtaaacccgaaggaatagaaggggaaggaggcatcggcagcgttgttcctcctcctctcctctcctgcatttctcaaactcaaatacctctcctctcacatcatggaaggcggagtcgtctttgaatctgtgcaaaacccactggatcgcctgaacactggaaatatggaccatggttgtgcccattacaggagacgatgtcggattcgggccccttgttgcaatgagatctatgattgtaggcactgtcacaatgaagccatgagccatctaaaggaccccttgctgcgccatgagctcccaagatacaaagttgaacgggttatttgttctctctgtgacactgagc

SEQ ID NO: 1651 - DNA, 424 bp, Pinus radiata; identical to SEQ ID NO: 512

SEQ ID NO: 1652 - DNA, 422 bp, Pinus radiata
gtcaatgctgcccgtcgaactggaggccctattgaaactatcaagaaatttaatgcaggatcaaacaaagcagcctcgagcagcaccaccttgaacaccaagaagcttgatgatgagacagaagttctcgctcatgaaagagtttcatcagatttgaagaaaaacataatgcaagcccgtttagataaaaagttgacacaagcccagcttgcacagcaaatcaatgaaaaacctcagattattcaagagtaccgagtccgggaaagcaattcccaatcagcagatcattgccaagctggaaagggtccttggtgtgaaactgcgtggaagcactggaagtggaaagaaataactggaagtatgcaatagcaataacatgtcatagagttgtgtgatttggcgttcaccacccacacctgctt

SEQ ID NO: 1653 - DNA, 357 bp, Pinus radiata
  misc_feature (1)...(357): n = A,T,C or G
gnacgagctcgatctggccttaaggggttacagaagaagaatttcgaagatgggtagatcttcttgctattcaaagcaaggtcatagccgtgggatttggacccctatggaggatatgattctctctgaatacattcgaattcatggcagtgatggatggaaaaatatcgctaaacgagcaggtcttaaacgacgtggaaagggttgcagattacgttggttgaactatcttcgccccgacattaaacgtggtaacatttctcctgatgaggaggacctcattattaggttgcatggccttcttggcaatcgatggtctttgatagcaggacgactaccgggtcgaacagacaacga

SEQ ID NO: 1654 - DNA, 306 bp, Pinus radiata
gcgcattgttcagctgtgtcgcagaacacggagcgaaagtcataatcgcagacgttgcagagaaagctggcagaaagcttgcagaatccctttctccagcatcggcaacttatgtgcactgtgatgtcagcaaagaagaagacgtgagcgcggctgtggatctggctatggataagtatggtcaactcgacattatgtataacaacgctggaactaacgacagctttctggtgaagagcgtggcagagtatgatatggagcaattcgatcgagtgatgaacgtaaacgtgaaaggagtgatgcacg

SEQ ID NO: 1655 - DNA, 368 bp, Pinus radiata
cttcagtttgccattgaagaccaataaataattattgtgaagcagcagcgttttaatcagagatccagcaagaagaggaccaggaaaaatcatttgcagaacaagaagataatccaagatgtcaagcacacgcagccctcagtgtgggtgcggagaaacttgcgcttgcgccgattgcaagtgtggagttgtgagtattgcgcctccatccgaccaaacaagtgggggacatgcatattgcaagtgtggagaacactgcagctgcaatccatgtaactgttcaaagattgacgagactgttagtgggaaatccttctgtaaatgtggagagaattgcgcctgtgaaacatgcacctgcagcagagctg

SEQ ID NO: 1656 - DNA, 333 bp, Pinus radiata
ttgaattcttgtcttccccccagctgaggctctctgagaccaaggtgagattcagccagtagtaagctatagattgatagttcagagaaaagactgaaaggcaaaaactatatagacataacaacggagagagcagcacaggaaccaggttgcataatggctaggcctcaaagatacagaggagtccgtcagaggcactggggatcatgggtctctgaaatccgccatcccttattgaagaccagaatatggctaggaacatttgaaacagcagaggatgcagcacgagcatatgatgaagctgcaaggatgatgtgtgggccgagagctaga

SEQ ID NO: 1657 - DNA, 355 bp, Pinus radiata
gttccccgtctcctccgtctgctaggcatttctctgcgattcttcttcttctgctcggggtctctctggtgaaatcgtccccgcaggaggagggctgagggcagggctcggctcggctcggttcgtttcggcaggagttatctcagggtttttctcttgattttctgcgccttcggactcgggcttacagttacagcatctggaaaatggcgtcacaggagagctcaaaaatgcaagaggaagggagtgggagacaagtgccggaagggcccattcactgtttgaacaactgcggcttcttcgggagcgcggccaccatgaacttgtgctccaagtgctacagagagcttaacgc

SEQ ID NO: 1658 - DNA, 341 bp, Pinus radiata
ggggaatgattcctggccgaggccattcgagcgccatacacattgcggcggactgcgggaagtattgttttcagtaattcccttaattgggtcccagaatacgttctcagatccgaaaacggttcagtccatcggaggttacagcgattcgaaggcctgaaaaccctaaaaatacctatccccctttgtctttgaatggcggagaactatggcagcccggatagcagcccccggtcggagaacgaatccggcggcggtcacatgggcggcagcgatttctctgtgaaagagcaggatcggttcctgcctatagccaacgtggggcgcataatgaagaaggc

SEQ ID NO: 1659 - DNA, 353 bp, Pinus radiata
gaaaaacaaagcagaaagccaccatgtggtagaggaggtgctgaggataaaggagcttcttgatgattcttatcagcctcaggaagtcttgctagagtcactgcagagtttgtttaacatgcatatttctgtggaggctttgaaggagactgatattggtagacaagtgaatggactgcgaaaacattcttctgctgacattcgaaagctagtaaaagagctcataaggaagtggaaagatcttgtcgatgagtgggtaagcactgcagatgaagttgcagctgctgcaattgttgatggagattctccacaaggtggtggcagcagaatttctcaacagagtattgtgcaga

SEQ ID NO: 1660 - DNA, 317 bp, Pinus radiata
caagagtaaacccgaaggaatagaaggggaaggaggcatcggcagcgttgttcctcctcctctcctctcctgcatttctcaaactcaaatacctctcctctcacaatcatggaaggcggagtcgtctttgaatctgtgcaaaacccactggatcgcctgaacactggaaatatggaccatggttgtgcccattacaggagacgatgtcggattcgggccccttgttgcaatgagatctatgattgtaggcactgtcacaatgaagccatgagccatctaaaggaccccttgctgcgccatgagctcccaagatacaa

SEQ ID NO: 1661 - DNA, 340 bp, Pinus radiata
caatggcggcccagactatcatcgctgcctctatggcatctcctctaacattatcaaatggccactatccgtttcagtccgagttcaaggggtccgtggttcgaatcccgcagagggcattttccttcgcgcctgcagcccgggcgctgaccgtcgtcgcagaggccaagaaggccgttgccgtgctcaaagggaattcacaggtcgagggtgttgtcagtctctcgcaggaagacagcggtcccacaacagtgaaggtccgtttgacaggactgactcctgggaagcatggctttcatctacatgagtttggtgacacaaccaatggctgcatatcaac

SEQ ID NO: 1662 - DNA, 563 bp, Pinus radiata
ttcggttcgtattcagggtttcgggagcttgttgtgtggtgttctgcaggtcaggacattgtaggcctggttatacaagatttcgaagcaaactctcggagcctcgaagaatcggcgcaaatttcaacggccttataactatttgggaagcagtactctggatttttctcccggaacggatcggagtgtgcgaagcgtaataatcgcctggaatttgtcttctgcaagataatattcaattaatctattgtcgaaggaaatttgagccgtataagaggataatcaaaagaagccggttgatttctccgggattaaaggatggatcaagaaaactggaacatcggagctgatggcactggctgccaactccagaagggcacactctttgcgccaataactgcggcttttttggcagttcggcaacgagaaacctgtgttcgaaatgttacagggatctgattatgaaggaggcccaagcctcatctgcaatggccgccgttgagaagtcatttgccgcgggttctccgatggaggaggaggcccctctttccaagccagatgtt

SEQ ID NO: 1663 - DNA, 572 bp, Pinus radiata
cagcaatggcggcccagactatcatcgctgcctctatggcatctcctctaacattatcaaatggccactatccgtttcagtccgagttcaaggggtccgtggttcgaatcccgcagagggcattttccttcgcgcctgcagcccgggcgctgacagtcgtcgcagaggccaagaaggccgttgccgtgctcaaaggaaattcacaggtcgagggtgttgtcaatctctcgcaggaagacaacggtcccacaacagtgaaggtccgtttgacaggactgactcctgggaagcatggctttcatctacatgagtttggtgacacaaccaatggctgcatctcaacaggagcacattttaatccaaaaaaattgacacatggtgctcctgaggacgatgtacgccatgcgggtgacctgggaaacatagttgcgggttctgatggagttgcagaggcaacaattgttgataatcagattccattgagtggacctgattcagttattgggagggcacttgttgtccatgagttaaaggatgacctggggaaaggtgggcatgaacttagcctgaca

SEQ ID NO: 1664 - DNA, 366 bp, Pinus radiata
atcgcttcggcccgagcaattttgcttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgccctgatctgaaacgaggaggtttttctgaagatgaagacgatcttattctcaaactgcacgccctcctcggaaataagtggtctctgatagcgggtcgtttgcctggtcgaactggccaccaaaatcaaaactactggact

SEQ ID NO: 1665 - DNA, 348 bp, Pinus radiata
  misc_feature (1)...(348): n = A,T,C or G
gcatcttgctcgtgactgcaccaacaacccagtttgtaatttgtgcaatatatctggtcatgtggccagggagtgccccaaggctcgcattttggatggtantaggggtggaagatttattgacgataggcgtggaagatttaatgacataatctgtaggacatgcaacgagccagggcataccagtagggagtgcactggaattctcatctgccacaactgtggtggccgtggacatgttgcatactaatgcccctctggtcgtgtgatgctgcgggacatgcgcaggcattgatgctgcaatttctacaacaccttgactttttagattatctgattttgacaaat

SEQ ID NO: 1666 - DNA, 422 bp, Pinus radiata
agagagaagggtgttccctggactgaagaagagcacaggcagtttttgatgggccttcgcaagtacggcaaaggcgactggagaagtatttctagaaactttgttgtgtcaaggacaccaacccaagttgccagccatgctcaaaagtactacattcggcttggttcggataataaaaacaagagaagatccagcatacatgatatcaccactgttcatggtacagacaggatgccttctcctttactgcacgtttctaataggcagactaattccccctcaacacaggcagaaatgaatcattcaccatgtctgacatatccatctcagatttcacgaggacctctaataaactctttgggacctcaaatagatggtaaccttctattttcacctcactatcctctaaatctgtataccca

SEQ ID NO: 1667 - DNA, 467 bp, Pinus radiata
cttgttgtgtggtgttctgcaggtcaggacattgtaggcctggttatacaagatttcgaagcaaactctcggagcctcgaagaatcggcgcaaatttcaacggccttataactatttgggaagcagtactctggatttttctcccggaacggatcggagtgtgcgaagcgtaataatcgcctggaatttgtcttctgcaagataatattcaattaatctattgtcgaaggaaatttgagccgtataagaggataatcaaaagaagccggttgatttctccgggattaaaggatggatcaagaaaactggaacatcggagctgatggcactggctgccaagctccagaagggcacactctttgcgccaataactgcggcttttttggcagttcggcaacgagaaacctgtgttcgaaatgttacagggatctgattatgaaggaggcccaagcctcatctgcaatggc

SEQ ID NO: 1668 - DNA, 465 bp, Pinus radiata
tccagatgttcgtggtagacatgaaattttagagctttatttgcaaaataagcctctggctgaagatgtgaatgtgaaagcccttgctcgtggtacacctggtttcaatggtgcagatttggcaaaccttgtcaacattgcggccatcaaggcagcagttgatggcagtgagaagttgtctgccaaacatctggaatttgcgaaggatagaataatgatgggaacagaacggaagtcgatgttcctatcagaggagtcgaaaaagctcactgcataccatgagagtggacatgcagttgttgcatttaatactgtaggtgcaaaccctatacacaaggctacaatcactcctcgagggagtgctcttgggatggttacacagctgcctgacaaggatgaaacatctgttaataaaacgcaattattagcacgacttgatgtttgtatgggcggacgagttgcaga

SEQ ID NO: 1669 - DNA, 421 bp, Pinus radiata
cgaaccatggagtctaagggacaggctaatccatctgttgcttctgtttgtaatctcagcaagaatggagagcgacgattggaagggaaagttgttatagtaacgggcggggcagcgggcataggagaagccattgttcagctgttcgcaaagcacggagcgaaagtcataatcgcagacgttgcagagaaagctggcagaaagcttgcagaatccctttctccagcatcggcaacttatgtgcactgtgatgtcagcaaagaagaagacgtgagcgcggctgtggatctggctatggataagtatggtcaactcgacattatgtataacaacgctggaactaacgacagctttctggtgaagagcgtggcagagtatgatatggagcaattcgatcgagtgatgaacgtaaacgtgaaag

SEQ ID NO: 1670 - DNA, 445 bp, Pinus radiata
ccatatcgaaacattcacagggggagattgatcaaacacaaataccgtaaaatcgcagcgaaaatccaaaattccaccatggggactgtggcggaggatggcagcaagggttacaaggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcctgttgttgggcaacttcctagttgcttggatggagagttcgtgcgcgttggtcccaatccgaaattcgcaccggtagctggctatcactggtttgatggagatggaatgatccatggtctcagaattaaagatggtaaagccacatatgtgtcacgttatgtga

SEQ ID NO: 1671 - DNA, 460 bp, Pinus radiata
cagacttttgctccgaactgttctgctgaaacaaaatccagtattgagctaggtttagaatcgggtttgctggtcatctgggagaggcgatccattcagcttcgcaggcccccgaagatggcgttcgccggcacaacccagaagtgcaaggcatgtgaaaagacggtctatttggttgatcaattgacagctgataattctgtttttcacaaatcctgtttccgctgccatcactgcaatggaactttaaagcttagcaactattcgtcgtttgagggagttctatattgcaaacctcattttgaccagctgtttaagagaacaggaagtttggataaaagttttgaagccattcctagagcatcaagaaatgacaagatgcatgagaatgagaacaggacacctagtagggtatcagcattgttttccggtacacaggataaatgtgttgcatgtggga

SEQ ID NO: 1672 - DNA, 301 bp, Pinus radiata
ttgttggtgggagacggagaacattgctttgttaaattggtcagcgggtttgcagctgaatccgaggctgttgcatccttaaaagtgttttacctttgtggtttggaccttagggtttgaactctttaaagaaactctcaaaatcagccttaaacaataacatacaagatgtccattctaccccaaagcgattccctcataataagggaagtttgggcagataatctggaggaggagtttgctttgattcgggaaattgtggacgattacccttatattgctatggatactgagtttcctg

SEQ ID NO: 1673 - DNA, 321 bp, Pinus radiata
aacacaaataccgtaaaattgcagcgaaaatccaaaattccaccatggggactgtggcggaagatggcagcaagggttacaaggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcctgttgttgggcaacttcctagttgcttggatggagagttcgtgcgcgttggtcccaatccgaaattcgcaccgg

SEQ ID NO: 1674 - DNA, 380 bp, Pinus radiata
cctgttcgatatcactgctgaacctatcagttgtccattaccttcgcctgccttgcctgtattgtcatcacagtcggcctctgatcaagaagaagccgaatcaggtgataattctgcaaattctgcagatgtagaaactcttcttcctcaggttgatgaaacagcttctgctgatctgacagtgttcccaggttttgttaccccttatgtaccatacgggttccccatatggcacacttttagacccacaataactcaaacttccaatgtttataagccaacagctgtaatgccaactgctccaataaaaatggacgaatgcacagggttatcccagttaagcctcggcggtgttgcagcggcttctgcaatgaaaccct

SEQ ID NO: 1675 - DNA, 350 bp, Pinus radiata
cccagctgaggctctctgagaccaaggtgagattcagccagtagtaagctatagattgatagttcagagaaaagactgaaaggcaaaaactatatagacataacaacggagagagcagcacaggaaccaggttgcataatggctaggcctcaaagatacagaggagtccgtcagaggcactggggatcatgggtctctgaaatccgccatcccttattgaagaccagaatatggctaggaacatttgaaacagcagaggatgcagcacgagcatatgatgaagctgcaaggatgatgtgtgggccgagagctagaaccaacttcccattcaatcccatgcacctccatct

SEQ ID NO: 1676 - DNA, 262 bp, Pinus radiata
aagtgagcttcatatctaaccaataataacacctgtatagcttcacagcaacagggcaccatgggccgagctcttgctgtgataaaatgggagtaaaagaaaggcccctggactctaacgaagataaaatactggtcgactacattaccaaacatggccatggcaactggcgtgcactgcccaagcaagcagggctcctgcgatgtggaaagaagttgtcgcctgcgggggacgaattacctgaaacccgacatcaaaagag

SEQ ID NO: 1677 - DNA, 357 bp, Pinus radiata
cgacaatggcgcggacgggattcgaaaccgcgacgctcggcctcgaacgtaccgaggcgttcgccgccggagctgggggaagtgggtgtccgagattcgcgagcctgggaagagaaagcgcatatggttgggatccttccaaacggcagagatggcggctcgagcttacgacgtggctgcgctcagcctgaagggaagatctgctttgcccaatttcccggattccgtccacacgctgccgcgcccctcttctctgaatcccagagatatccagcttggcggctgcccaggcagccgcgaattaacgcagccgatggtctctaccgatatttcatcctgcaaccgcaagatcaaaat

SEQ ID NO: 1678 - DNA, 354 bp, Pinus radiata
  misc_feature (1)...(354): n = A,T,C or G
cacgaggcagtatctaccaatgtcggggagagacaggaagcttgttgtgcttggtattccttgggatgtcgacactgaaggtttacaggattatatgagcaagtttggagaactggatgatgtgattgttatgcgggatcgtgcaactggtcgttctcgtggatttggttatgccacattttcttcagttgaagatgctaagaaagcacttgacagtgaacatgttctaaatggtcgtacactggaagtaaaggtggctacacccaaggaggagatgaaggctccttctaagaagattacccggatatttgnggcaaagaattcccccttctgttacagaggatgcattccgaa

SEQ ID NO: 1679 - DNA, 174 bp, Pinus radiata
gtccgggcggtggagagcatcagccttggagttacagaccaggaaaatacaagatgggtagatctccttgctgctccaaagaggggctcaaccgcggggcctggaccaaaagggaggatatgattctctccgaatacgttcgaattcatggcgatggtgtatggaaaaatgttg

SEQ ID NO: 1680 - DNA, 221 bp, Pinus radiata
gttcattaagcatggagccaaagtcataatcgcagacgttgcggagaaagttggcaggaagcttgaggaatcactttctcccgctgtggcaacctacgtgcactgcgatgtgagcaaagaagaagatgtgagcgcggcggtggatgtggccatggataagtatggccaactggacattatgtataacaacgctggaactaatgacagatttttggtgaaga

SEQ ID NO: 1681 - DNA, 363 bp, Pinus radiata
gcttaggcgcattaaggagcaaaggaagggaaaatatcacagcgacacagcaaaacagagacagtcacaagaacaagcccgaaggaaaaagatgtcccgggcacaggatggtatactgaagtacatgctgaaaatgatggaagtttgcaaagcacaaggttttgtatatggtatcattcctgaaaaagggaagcctgtaagtggagcctcggacaatcttaaagcatggtggaaggagaaggtcagatttgataggaatggccctgctgcaatcaccaaatatcaagcagaacatgcaacacctggagcaaatgagagtaacatggttgtggctcctacccctcatactcttcaggaacttca

SEQ ID NO: 1682 - DNA, 374 bp, Pinus radiata
ctgatttgaagtgctcattcatgaacaatccgagcagcagttatgcataaaatgttgattgcagggctccgttattgcgagcaactaaagggcgatggtgttacaatcaaatatcgagaacgagaatgaatctgaagcctctcggaatgctacaaattggtaatttggctcctgttagaagagcattctcatcacctagagcctcagcagatgaagaagctgctgcaaaagcagctgctgctgtagcagagacaggagccccaaccatatttgacaagatcataaagaaggaaattccagcaactattgtttatgaggatgcaaaagtgttggcatttcgagatattaatccacaggcaccagtccatatattg

SEQ ID NO: 1683 - DNA, 407 bp, Pinus radiata
gccgtggctgttcccaggagaggagagcctcagctgtctcgatctggccttaaggggttacagaagaagaatttcgaagatgggtagatcttcttgctattcaaagcaaggtcatagccgtgggatttggacccctatggaggatatgattctctctgaatacattcgaattcatggcagtgatggatggaaaaatatcgctaaacgagcaggtaaaattctaatagcaatttttattgcaaacgtaatactcattgagaggttaactaagcgggcagtttttgttctgcaggtcttaaacgacgtggaaagggttgcagattacgttggttgaactatcttcgccccgacattaaacgtggtaacatttctcctgatgaggaggacctcattattaggttgcatgg

SEQ ID NO: 1684 - DNA, 361 bp, Pinus radiata
gttccagaccttttgcatcttcattattcttccgcctgtgaaaagatggggagatctccgtgctgtgagaaggctcatactaacaaaggggcctggactaaacaagaagatgaccgccttatcgctcacattcgagcccacggcgaagggggctggcgttctcttcccaaggccgcagggctgctgagatgcggcaagagctgcagactgcgatggataaactacctgcgtcccgatctgaagcgtggaagcttcacggaagaagaagacgaactcatcatcaaactccactccttcgttggcaacaagtggtctttaattgcagggagattgcccggacggacggacaacgagataaaga

SEQ ID NO: 1685 - DNA, 340 bp, Pinus radiata
caagagtaaacccgaaggaatagaaggggaaggaggcatcggcagcgttgttcctcctcctctcctctcctgcatttctcaaactcaaatacctctcctctcacaatcatggaaggcggagtcgtctttgaatctgtgcaaaacccactggatcgcctgaacactggaaatatggaccatggttgtgcccattacaggagacgatgtcggattcgggccccttgttgcaatgagatctatgattgtaggcactgtcacaatgaagccatgagccatctaaaggaccccttgctgcgccatgagctcccaaaatacaaagttgaacgggttatttggtctc

SEQ ID NO: 1686 - DNA, 332 bp, Pinus radiata
ggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttg

SEQ ID NO: 1687 - DNA, 347 bp, Pinus radiata
gattgatcaaacacaaataccgtaaaattgcagcgaaaatccaaaattccaccatggggactgtggcggaagatggcagcaagggttacaaggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcctgttgttgggcaacttcctagttgcttggatggagagttcgtgcgccgttggtcccaatccgaaattcgcaccggtagctggctatcactg

SEQ ID NO: 1688 - DNA, 354 bp, Pinus radiata
cgataggcgtggaagatttaatgacataatctgtaggacatgcaacgagccagggcataccagtagggagtgcactggaattctcatctgccacaactgtggtggccgtggacatgttgcatacgaatgcccctctggtcgtgtgatgctgcgggacatgcgcaggcattgatgctgcagtttctacaccaccttgactttttagattatctgattttgacaaatctattttgaatttggaagttctttttctgagtagttagatcagtagacctgtcgtatcagttattatacagttttcttatactagtcctttacttcaagactggctgatatacttctattttcatatga

SEQ ID NO: 1689 - DNA, 348 bp, Pinus radiata
ggagattcctctctgcaaaatgcgctggaccttgctcatggttatctgagccagattccatcatatggtcatcgggaagttctagtcttgtattcagcactaagcacttgtgatccaggggatatcatggaaagtataaagaaatgcaagaattcgaaaatgcgatgctcagtggttggattatctgcagaaatttatatttgcaaacacctctgtgaggagacgggaggattctattccgtggcacttgatgagtcacatttcaaggaccttctgcttgaacattgccctccaccaccagccatagcagagtttgcagttgctagcttggtcaagatgggatttcct

SEQ ID NO: 1690 - DNA, 349 bp, Pinus radiata
tgcataccatcattgtaatggaggtgaaaggaataggagtgggattcttattaagcaatggaaggttacgctgcgaataacgatgcagaacttctgagcaaaacccttcaagtggaacagaagttgttctatttcgatctcaaggaaaacccccgaggtcaataccttaaaatctctgagaagacctccggctcacggtctacaataattgtgcccattggtggagttgcatggttcctcgatctctttaattattatgtcgacggagatgacgaggaagttttgagcaaggaattgcagctggatgccaaggtattttatttcgatgttggggtgaataaaaggggtc

SEQ ID NO: 1691 - DNA, 339 bp, Pinus radiata
ctgaagtgccgtcgattgttcgggaggatagcgttttcgaagttcgttgttgagttatctcgcgagactgtagaattttagggttgttttccacaaaccgacttttcccgacttcaaatcttgatattgaagtgacatggccggcgagaaaagaaagattaatagaatagctaacgcttcggccaggcaggtcaccttcgcgaagaggcggagggggctgttcaaaaaagctcaggagctatcgattttatgcgaagccgatgtagccctcctcgttttttcttcaactggaaagctgtaccagtactccagctccagcatgaaaatgatattggacca

SEQ ID NO: 1692 - DNA, 380 bp, Pinus radiata
gaaaccatgagggtcttgccacaaggtttgttgagccacaacctgaatggtcagtatttcgtgaggcgagctttggacatggggaacttagagttgccaatgcaacacatgcacattggagctggcatcgtaatgatgatgatgagccagttaaatctgatgaagtttggatcaataatcttagccaatcaagagaatgtatagaaagtaccgactacagtggaaggaaaatactaattgcaccttgagtatatgcttggagggagaagtgatctaactgtaattgccaaggcaaaacactgagtgtgagctcatgcacggcaatgaatttatggttcagtgtttagttgtatggaagtatattattcattagacatgca

SEQ ID NO: 1693 - DNA, 442 bp, Pinus radiata
ggatatcatcagctgtccagtttgtcctaagagactacagaagaagaatatagaagatgggtagatccccttgccccccaaaagaagcgcttaaccgtggggcttggacaggcatggaggatacgattctcaccgagtacattcgagttcatggcagtggtggctggaaagatatctccaaaagagcaggtcttaagaggtgtgcaaagagttgcagattgcgttggctgaactatcttcgtcccgatattaaacgtggtaacatttctcccgaggaagaagagctcattattcggttgcatcgccttcttggaaatcggtggtctctgatagcaggacgactgcctggtcgaacagacaacgaaatcaagaattactggaacactcatatgagcaagaagccatggctgtcaatggacgaatctcagtccaatacttcgca

SEQ ID NO: 1694 - DNA, 351 bp, Pinus radiata
tttttttttttttttccttactcccacctttttgttcgtctgcgcatggttttgtatctgatgtcaaaattgtctgcaacgcatgctgatgttgattcccatgcccgactacaacatctgcacaaataggaagttaagaataaagcgaacaataaaagtgccagccattagcagtaaattggcagatatccctcccgatgattattcgtggaggaagtatggacaaaagccaatcaagggctccccacatccaaggggctattataagtgcagcagcatgagaggttgtcctgcccggaaacatgtggagcggtgtccagatgaaccttccatgcttattgtgacttatga

SEQ ID NO: 1695 - DNA, 304 bp, Pinus radiata
caaggccgtaaatccccatcccaaaaagggcgtcccctcgtggctggtggacatggtggagaaactggtggttgaaacttctgcgttgtatagttccaagaagcctctgcattttcttttggggaacttcgctccagtctcggaaactgcccccaaatcgcacctgcctgttgttgggcaacttcctagttgcttggatggagagttcgtgcgcgttggtcccaatccgaaattcgcaccggtagctggctatcactggtttgatggagatggaatgatccatggtctcagaattaaagatggt

SEQ ID NO: 1696 - DNA, 371 bp, Pinus radiata
gcgtggatgtacaacgaatatggatccatagaggtcctgcactttggggatttccctgttccaaagcctgggttaggccagctcttaattcgagtccgggccgctgctcttaatcctgccgactttaagagacggaaaggcttattaagaaacgcggattccgattttccgactgtgccaggctgtgatatgtcaggagtggtggtggaaattggtgatggtgtctccaagttcaaggccggtgacgagatatacagcaacatccagaatttcgcagcagggaggccaaagcagtgcgggactctcgcccagtacacagtggtggaggaattcctggtagcgccgaagcccagtaatttatcatttgagga

SEQ ID NO: 1697 - DNA, 523 bp, Pinus radiata
ccttcatggatatgttggagttgattcgccaccatttgctggaagtggaggacaatatagatatagatattgatattgagggaacttcgccgttgttcttcacccccactgccattgagagtggcgattatattaatattgatgatcatgacgatgatacccgagcaaatgccagagcgaccagggcctcatgccaaaatatcgtcagcagaacaacattaaaagagaacgcgaatgaatttacacaacagatccattcttcatcttctccaagatgctcagttatgaaaggagcagaggcgtttcaggtaaagcaacaaccacgggagcgggagaatggaaagaagagagagacaagtgccaggaattacagaggagtgaggcggcggccgtggggaaaattcacagcagaaatcagagattccgccgcgaagggtgctcgggtttggcttggaactttcaacaccgtcgaagaggctgctcatgcatatgaccgcgctgcctacagattccgtggagctcg

SEQ ID NO: 1698 - DNA, 471 bp, Pinus radiata
cgcgatagccgagagcacccttatctcctccactctgtttcatacatgcaacaagctctggcagcagcaatggcggcccagactatcatcgctgcctctatggcatctcctctaacattatcaaatggccactatccgtttcagtccgagttcaaggggtccgtggttcgaatcccgcagagggcattttccttcgcgcctgcagcccgggcgctgaccgtcgtcgcagaggccaagaaggccgttgccgtgctcaaagggaattcacaggtcgagggtgttgtcagtctctcgcaggaagacagcggtcccacaacagtgaaggtccgtttgacaggactgactcctgggaagcatggctttcatctacatgagtttggtgacacaaccaatggctgcatatcaacaggagcacattttaatccaaaaaaattgacacatggtgctcctgaggatgatgtacgccatgcg

SEQ ID NO: 1699 - DNA, 483 bp, Pinus radiata
cttcctggtgttgttgctgtgatttctctgccattctgtgttgggtttatggttttagcttcactacaagcctttagcaagcctcacaaataagctttgcagtaggatgtctcctcccccgtcatattccatgtttcccaattcaggaatgggcttaaatccctcagtgacatcttcagaaccctctagtcaggtctccggatcgatcccccatcaatattcaggctccgaggaagaccctaaactgacgatcgatgaaagaaagcagaagagaatgctttctaacagagaatctgcaaggaggtccaggatgagaaagcaacagcatttggatgaattgagagccgaagcagctcatctcagagcagagaacagtcatatgctaacaaaattcaacattgcttcacagaaatacatgcagctggaagaagagaattctcttctgaggtcctatgccatggatttaagcctcaagctgcagtc

SEQ ID NO: 1700 - DNA, 442 bp, Pinus radiata
ttttttttgaatagaaaaaatataattaggtacttttccttagaatgttgcagataattgcatttactttcctaagaagccattgtctaactttagaccatgatatgcagttactgcaaagatcttgacaaacctaaccaatcacttatacctactgtcaagtaaatatgtaacaaatatcaattttcaatcaaaggtgccattaagagttttaaccaacaaggtgaaggcaatgaatctctagatctcactaacctaattctgctctacctaccaagctagcagtctggcttgaaattagcagaacttccaatggttattacaatttacacatgtcacaaatgtagtcataggttcatctgcacttcttgtttgcaactgatagtaagtacacttccgctggccacatttaccacacttgaattggtctgttgtagcttta

SEQ ID NO: 1701 - DNA, 316 bp, Pinus radiata
ctaaattcatatgctggacatacgtgatgtcatggcaggtgttcttgctgtaaagaggaaaagtttggccaaagatatctatttcctacagaatgcagaaggttcaggtctggctccatttgactgttggctatgcttgcgagggatcaaaacaatggctttgcgcattgagaaacaacaggagaatgcaaggaaaattgcagaatttttgtcatctcatcctctgattgagaaagtatattatgctggccttcctagccacccaggccacaatttacattttttgcaggcaaaaggaggaggttcagttcttagc

SEQ ID NO: 1702 - DNA, 329 bp, Pinus radiata
ataatgtcatattttatatccagagacttgaactatttgtatgttgtaattcatattggttgacatgattgatatgtacatatgttacatggtattagcatgaggatgttgatgtttgaccttatttaagtgttcgtaggttgtaaaaaaaaaaaaaaaaaactcgagactagttctcctcgtgccgaattcggcacgagggaacagctgaggaagagcaagaagaggtgttttgcgtgtaacaggcgggtggggctgacgggctttaagtgccgctgtggtgaccttttctgcgctcagcacaggtactctgatatgcatgactgctc

SEQ ID NO: 1703 - DNA, 325 bp, Pinus radiata
  misc_feature (1)...(325): n = A,T,C or G
ctcgtgccctggtgcaaagattgttataagaggcaagggttctgtcaaggaaggtagattacagcaaaaacgtgatctgaaacctgatccatccgagaacgaggacttgcatgttttggttgaggcggagacacaggatgctttggaaaaagctgccggcatggtggagaanctgcttatgcctgttgacgagggtttgaatgagcacaagcgggcgcagttgagagagcttgcggcacttaatgggacaatacgggatgatgaattctgcaggctttgtggtgaaccaagtcataggcaatatgcttgccctacaaggcttata

SEQ ID NO: 1704 - DNA, 453 bp, Pinus radiata
cttagcgtctatagaagagcagggactaattccatctttctccatttctatttctcttcccaatcaaaaccatggcgtctaacggacagcttaatgcaggcactggctgtgttggtgatctgaccaatgttggagatcgacgattggaggggaaggttgcaatagtaacgggcggggcagcgggcataggagaagccattgttcagttgttcattaagcatggagccaaagtcataatcgccgacgttgcggagaaagctggcagaaagcttgagcaatccctttcacccgctgtggcaacttacgtgcactgcgatgtgagcaaagaagaggatgtaagcgcagcagtggatgtggccatcgacaagtatggtcaactggacattatgtataacaacgctggaactaacgacagcgttttggtgaagagcgtagcagagtatgatatggagt

SEQ ID NO: 1705 - DNA, 242 bp, Pinus radiata
gaaaaggtcaattatcctgtgttgctacggaaatctaaatattcaaggttatggtatatgccagataagattttctttactccaaaagctgtcatcaaactggattttcactgtcctgaatcaaactgttcaccagaagcagtacttctaacttgtatttttactgcattattggtggattatttaaatgaatacggtgactataagtggatacagtcataagatgagaattttactggaga

SEQ ID NO: 1706 - DNA, 358 bp, Pinus radiata
gttttgggtttctgtttttaaccttggaaggttcaattttacagtttctacgggaattctcatattcaatctgtttggcagattgaactaaagatttttgtccgggtgatttttggattaaattcaaggtcgacgaacgtgaggtgctagggcttttagagtttggatggaacccatggacatcgttggcaagtccaaggatgacgtctcgcttcccaaagcaaccatgtttaaaattataaaagagatgctgcctccagatgttcgtgttgcaagagatgctcaggacttactggtcgagtgttgtgtggagtttatcaatctaatatcttcagaatccaatgaagtttgtggcaga

SEQ ID NO: 1707 - DNA, 334 bp, Pinus radiata
cgtttgcttgccgtgaaagaaatcgaacttccggcgcttgggtgcgagaaatatttgcaaatcgaacttccggcttgggtgcaagaagcttttgcgttttcggtttcagattaaagcaatatggagtcagaggaagacaaaatatctccagagaacaagaaaaggagattaaaaaccccacagcaggtcgaaggtctagagagcttttatgctgaacataagtatccttcggaagctatgaaatcacagttatcagaagaactgggattaacagagaagcaggtacaaggatggttctgtcacaggaggcttaaggataaaaggctcatgaagg

SEQ ID NO: 1708 - DNA, 288 bp, Pinus radiata
gcatcggcagcgttgttcctcctcctctcctctcctgcatttctcaaactcaaatacctctcctctcacaatcatggaaggcggagtcgtctttgaatctgtgcaaaacccactggatcgcctgaacactggaaatatggaccatggttgtgcccattacaggagacgatgtcggattcgggccccttgttgcaatgagatctatgattgtaggcactgtcacaatgaagccatgagccatctaaaggaccccttgctgcgccatgagctcccaagatcaaaagttga

SEQ ID NO: 1709 - DNA, 406 bp, Pinus radiata
gttccccgtctcctccgtctgctaggcatttctctgcgattcttcttcttctgctcggggtctctctggtgaaatcgtccccgcaggaggagggctgagggcagggctcggctcggctcggttcgtttcggcaggagttatctcagggtttttctcttgcttttctgcgccttcggactcgggcttacagttacagcatctggaaaatggcgtcacaggagagctcaaaaatgcaagaggaagggagtgggagacaagtgccggaagggcccattcactgtttgaacaactgcggcttcttcgggagcgcggccaccatgaacttgtgctccaagtgctacagagagcttaacgccaaaccaccttctttttcttctcacttgaaacctcagcaacctacgcttga

SEQ ID NO: 1710 - DNA, 434 bp, Pinus radiata
ccctcttcatcatcggcaaactcattatctcattcatcatttggtggaacctggccacaacctagtgtaccaacattgcatcttcccggtggcagtcttcaagttggtcttcaagctagtcgcctccgagcatcacttaatgccagagatgtacctcttgaggaattgaccttagattcggattgtgaagggcaacttataaatgattttgcttctctttcaggatctggaaacaccttgatgaggtctggaaaatacaagagtcatggctgtagtattgctccagttaatcttgaggatctatttgcttctgagatgtctcctaggggaccgtgccttgaaccttccgtgttttctcaaataagttctcaaattcagtcacataaggcagctcaagttcagcctcaggtgcaaacatcaattagtaatcagat

SEQ ID NO: 1711 - DNA, 387 bp, Pinus radiata
tttacttacacaccacctggaaatgaagatcgtcacttgctattcgttgatgagttacgtggtcgcttagtgactcttctagggggacgtgctgcagaggaagtggtatactcaggtcgtgtttccactggtgcacttgatgatataaagcgtgcaacagatatggcatacaaagctgtcgctgaatatggtcttaacaagtccataggtccaatttcattggcgactttgtctggtggcggtcttgatgagtctggaggagcaatgccatgggccaaggatcagggacatatggtagaccttgttcaaagagaggtgaaaattttgctacaatcggctttgacaatggcactccttgtcatacgctctaatcccactgtacttgag

SEQ ID NO: 1712 - DNA, 440 bp, Pinus radiata
ctccttagcgtctatagaagagcaaggactaattccatctttctccatttctatttctcttcccaatcaaaaccatggcgtctaacggacagcttaatgcaggcactggctgtgttggtgatctgaccaatgttggagatcgacgattgcaggggaaggttgcaatagtaaccggcggggcagcgggcataggagaagccattgttcagttgttcattaagcatggagccaaagtcataatcgccgacgttgcggagaaagctggcagaaagcttgagcaatccctttcacccgctgtggcaacttacgtgcactgcgatgtgagcaaagaagaagatgtaagcgcagcagtggatgtggccatcgaaaagtatggtcaactggacattatgtataacaacgctggaactaacgacagctttttggtgaagagcgtagaa

SEQ ID NO: 1713 - DNA, 446 bp, Pinus radiata
  misc_feature (1)...(446): n = A,T,C or G
ggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccntcgccttcttggcaatcgatggtcgcttatagcaggaagattaccaggtcgaacagacaacgaaatcaagaactactggaacactcatatgagcaagaagctgcttccattgaacgaatctcaac

SEQ ID NO: 1714 - DNA, 519 bp, Pinus radiata
attcatttccgtgtaagttgcaacgcctcattgtttcctcaacctagtgagtaacattcgtgaattcgttatgcaagtagcttgcggaagggcacttctatcatgttattcttattccgagctactgtcagctatatgatggacctgtgttttcatcactggctcacttcacctgtttgagtatctgccatttttggatgtttgtgtaagcttggctaaataccagagacacaaagaaaccgtcctgtagccggagttatcgaaactatttacaatgccacgggtgaaatttatttccaggaacttcatggacatggtggcagcattaccggctgcaaagttagatcggctttatgatagtcatttcatttgcgaagcggttctgaggtctctgactcctgtgccaaagaaatatgtattgcaactattatatattgacgttgcggtgcctgccaaatcactggaggaatgggttctttcagatggcctgtctaagcacaaagcagcaattgataggtt

SEQ ID NO: 1715 - DNA, 162 bp, Pinus radiata
cggcccgagcaattttgcttctctgctaaacgatgggaagagcgccttgctgtgccaacggtgacagaagcaagggagcctggaccaaggaagaggatgacaggcttacccaatatattcaggctcatggagaaggatgctggcgttctctccccaagggcc

SEQ ID NO: 1716 - DNA, 481 bp, Pinus radiata
gttacagtagtgcgtacaaaattccagtgacattgacttgcaatctacttttatggagtaggtagggctccgtgaaattgcgcatgtcatgaatgtgctcgtctgtaagtggctgctttacgccggcgaaggttcggaccctgtggtggtggtgaattgactgtaagaggccgccgatctcgatcgaaggtgtacagagatcattaatggcgatgccgatgccgttgcttgtgaattgctctggctgtcagacgccactgcagctaccgccgggggcgaagtcgatacgctgtgctctgtgtcaagcggtcactcatgtagcggaacatcacggcgatattccgcctcgaggttaccgccaccagcagccattggctcctcccgcggtcagtccccagcactattcgcccgctccgccttcttcccacggcaggaagaaggcggtcgtctgcggcatttcttacagatattcccagcacga

SEQ ID NO: 1717 - DNA, 546 bp, Pinus radiata
agaagtgccaactgcaaactttgatttacaccatgctcactgtatacgaaacttgcagcgctgcactgtttgcggggatatgattccaaaaagtcgttctatggaacaccaccaggatacccatgctcctgtatcttgttcacagtgtggcgaatccattgaacgtgaattactagtcatccatgagcgtgacaagtgtcttcatagaattgttacatgtggttattgcgagtttccactgccagctgttgatcttgataaacatctgaacatctgtgggaatagaacagagtattgtaatccgtgcagcaagtatgtgagattgtgtgaaaagctagctcatgatttacagttccatgaaggaaattctgatgacactggggattcttcaagagagcagcacggggaaaataatcacagctcaccagcagcagaactgtctcggagagttcctagggaacggccacgagatacctcgcagcgtcgttggcttgtcacattagcaatcacaggaattgccataattataggatcatttgttcttca

SEQ ID NO: 1718 - DNA, 631 bp, Pinus radiata
tataaccgcctcttcttatactagtgcctttatcggttccattcaaacttgctcacggattccgacccttccggctaaagctgctgcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcgtcatcaaactccactccctactcggcaacaagtggtctcttattgcaggcagattgcccgggcggacggacaacgagataaagaactactggaatactcacatcaagagaaaattgctaaacaggggactcgacccccagtcccatcgccccctcggccagccgcacaacagcaacacgacctgcccctctctgcccgccctcgagcacgaaattcttgtgttccagaggccaagaacgccggagatagcagatttctttcaatacgagcgctctgaaagctcgccgatggaa

SEQ ID NO: 1719 - DNA, 561 bp, Pinus radiata
gaacgaacggtgaagatacacagaggatctctcaacggcttcatctccgtcgtcgtctctcctccttccatctccagcgtccgatctgatcttatcaaaggaagcccttaaatccctccagctttccaagcgcgggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggaatttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatg

SEQ ID NO: 1720 - DNA, 497 bp, Pinus radiata
ttattttgcagcatcgagaggcagcagctacggactaatcgatccatcatagccatttttaatttcgctgcccaatcgaaccatggagtctaagggacaggctaatccatctgttgcttctgtttgtaatctcagcaagaatggagagcgacgattggaagggaaagttgttatagtaacgggcggggcagcgggcataggagaagccattgttcagctgttcgcaaagcacggagcgaaagtcataatcgcagacgttgcagagaaagctggcagaaagcttgcagaatccctttctccagcatcggcaacttatgtgcactgtgatgtcagcaaagaagaagacgtgagcgcggctgtggatctggctatggataagtatggtcaactcgacattatgtataacaacgctggaactaacgacagctttctggtgaagagcgtggcagagtatgatatggagcaattcgatcgagtgatgaacgtaaacgtgaaag

SEQ ID NO: 1721 - DNA, 394 bp, Pinus radiata
aataaattgggttgcaaagctttccagttgtttgccagcattgaggtggctgagacttgaagaaagtgtacaacaatttgctgtctttatgttgtctcaagtcgatctttccagagaagctgcacacttgaaccgctttctttacaattttcgcaggtggaaagatgtgtcatttcctaagcccttgtacccacttgtacacccggcagttttggtggagacttatgaacaaggcgagagtgtggcacgctatgttgatcagccagaagcaaaccatagttttaatagatcacttgctcacactggcacgcatactctcctcaagatgctactggtggataatttcatccatgcagatatgcatcctggaaatattttggttcgaatgggacaa

SEQ ID NO: 1722 - DNA, 394 bp, Pinus radiata
taaggctaagcagaccagaggaggtgaaggagaaaaaagaaacaatggctggaataggaccgattagtcaggattgggaacccgttgtcatcaggaagaaggctcctaacgctgcagccaagaaggacgagaaggctgtcaatgctgcccgtcgaactggaggccctattgaaactatcaagaaatttaatgcaggatcaaacaaagcagcctcgagcagcaccaccttgaacaccaagaagcttgatgatgagacagaagttctcgctcatgaaagagtttcatcagatttgaagaaaaacataatgcaagcccgtttagataaaaagttgacacaagcccagcttgcacagcaaatcaatgaaaaacctcagattattcaagagtacgagtc

SEQ ID NO: 1723 - DNA, 317 bp, Pinus radiata
gattcttcttcttctgctcggggtctctctggtgaaatcgtccccgcaggaggagggctgagggcagggctcggctcggctcggttcgtttcggcaggagttatctcagggtttttctcttgcttttctgcgccttcggactcgggcttacagttacagcatctggaaaatggcgtcacaggagagctcaaaaatgcaagaggaagggagtgggagacaagtgccggaagggcccattcactgtttgaacaactgcggcttcttcgggagcgcggccaccatgaacttgtgctccaagtgctacagagagcttaacg

SEQ ID NO: 1724 - DNA, 265 bp, Pinus radiata
cggattccgacccttccggctaaagctgctgcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcag

SEQ ID NO: 1725 - DNA, 284 bp, Pinus radiata
caagagtaaacccgaaggaatagaaggggaaggaggcatcggcagcgttgttcctcctcctctcctctcctgcatttctcaaactcaaatacctctcctctcacaatcatggaaggcggagtcgtctttgaatctgtgcaaaacccactggatcgcctgaacactggaaatatggaccatggttgtgcccattacaggagacgatgtcggattcgggccccttgttgcaatgagatctatgattgtaggcactgtcacaatgaaaccatgagccatctaaagga

SEQ ID NO: 1726 - DNA, 308 bp, Pinus radiata
caaaccgccaagtgagcttcatatctaaccaataataacacctgtatagcttcacagcaacagggcaccatgggccgagctccttgctgtgataaaatgggagtaaagaaaggcccctggactctagacgaagataaaatactggtcgactacattaccaaacatggccatggcaactggcgtgcactgcccaagcaagcagggctcctgcgatgtggaaagagttgtcgcctgcggtggacgaattacctgaaacccgacatcaaaagagggaattttagtccagaagaggaagatcaaattattaa

SEQ ID NO: 1727 - DNA, 338 bp, Pinus radiata
gacgagcggttgttcattaagcatggagccaaagtcataatcgcagacgtcgcggagaaagctggcaggaagcttgaggaatcactttctcccgctgtggcaacttacgtgcactgcgatgtgagcaaagaagaagatgtgaccgcggcggtggatgtggccatggataagtatggccaactggacattatgtataacaacgctggaactaatgacagctttttggtgaagagcgtggtagagtatgatatggagcaattcgatcgagtgatgaatgtaaacgtgaaaggagtgatgcacggcattaagcaccccgcccgcgttatgatcccgcggaa

SEQ ID NO: 1728 - DNA, 350 bp, Pinus radiata
  misc_feature (1)...(350): n = A,T,C or G
gcacgaggttttaacatcttttgttgatatccagaggcttgatgatgtgaaaaatgccataacaccatctaccaaggttttgtattttgaatctatctcaaacccaactctggcagttgcagacatcccatctctgtctgccattgctcatgagaaaaatgtcaaggtggtggttgataataccttttctcccatgatcatatcccctgcaaagcttggtgctgatgttgntattcacagcatttcaaaatatatcagtggaggtgctgatgttatagcaggagcaatatgtgggcctgcagatctgataaattccatgatggatctccatcagggaaccttgatgctct

SEQ ID NO: 1729 - DNA, 333 bp, Pinus radiata
ccagtccatggtttcaagttagttagtccaataaagcagagatgggtcgtgctccatgctgcacaaaagttggtctcaacaagggagcatggtctgccgaagaggatagtcttctgggaagatatattcaaactcatggtgaaggcaattggaggtctctgcccaagaaagcagggctgcgaagatgtggaaagagctgcagattgcgttggctaaactatcttcggccatgtatcaagcggggaaatattacaacagatgaagaagaacttattatcagaatgcatgctctcttgggcaaccgatggtcgataatagcagggagagtccccg

SEQ ID NO: 1730 - DNA, 508 bp, Pinus radiata
  misc_feature (1)...(508): n = A,T,C or G
ctngtgccgaagaaatctgaatcgtcgcgttcgtggtcgacaggaagccacagtgggcggcctgagaaactggttgtggtggtcgggagtgtcaagattgtgacggtgggcggaccagcgtctagtttgtgttggtggtcggcattagaaggggcagagggggcttttcagtgcatgggattatgggcaacgaaggcgcggcatcgatgcggctatggggcgacgataataattccatgatcgaggctttcatggggaacctcgattactcttactccaccttctggaatggcatcgatgccaatccctcttcgctaccctcgcccgccacttcccgtcgtctgccgcagtgttgctatcgccacgcccttcaatcaggacacgctgcagcaacgcttgctggcgtttgtggagggagcggctgagtgctggacttatgccatattctggcagttgtcgagcgatgccagcggcggctcggagcttgtctggggcgacgggtactaca

SEQ ID NO: 1731 - DNA, 411 bp, Pinus radiata
  misc_feature (1)...(411): n = A,T,C or G
cggagtgaaatcatttgctgccgtcactgctgccaaggtttgttactgttagattttgttatancggacaatggcttcaacagacatagatatgattcccgtgccctctggcgagggttccagctctcaagcgggaccaagcgcttccaccaagaaggccaaacgtttcgaaatcaagaagtggaatgctgtagccctttgggcgtgggatattgtggttgataattgtgcaatttgcagaaaccacatcatggacctctgtattgagtgtcaggcaaatcaagcaagtgcaacaagtgaagaatgtactgttgcatggggtgtttgcaatcacgcctttcatttccattgcataagtcggtggctcaagacacgacaagtctgcccattagataataagtgagtgggagt

SEQ ID NO: 1732 - DNA, 390 bp, Pinus radiata
cgaaactcgaatcgatatgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggcccgtggagccccgaggaggacgcgtcgctgcagaggcttgttcagaaatacgggccgaggaactggaccctgataagtaaaggaatcccggggcgatccgggaaatcgtgcaggctacggtggtgcaatcagctgaccctcaggtggagcacagacc

SEQ ID NO: 1733 - DNA, 277 bp, Pinus radiata
atttactggaaccattgttggaataagtgatgctgatcctgtgaactggccgaattcaaagtggagatgcctcaaggtacaatgggatgaaatatcagcaattgcacgaccagagagagtttccccgtggaaattagaaccttcattaactccagtggcagtgaatcctctgccagtagccaggggcaagaggcctcggccaaatatattaccttcatcttccgatttatcagtgcatgacaaggccccagtggattctactcaggtgcacaggttt

SEQ ID NO: 1734 - DNA, 221 bp, Pinus radiata
gttgcagggaagggttgccgtgatcacaggaggcgccagtggaatcggagaggctaccgccaagttgttcgtggagaatggagcgaaagtagtgattgcagaccttcaggacgaccatggaaaccgtcttgctcaatccctcgctcccaacgcctgctttttccactgcgatgtctccaaagaggcggacgtttccgccgtgctggacttggcgctggaga

SEQ ID NO: 1735 - DNA, 316 bp, Pinus radiata
  misc_feature (1)...(316): n = A,T,C or G
tgggctgttcccaggagaggagagcctcagctgtctcgatctggcgttaaggggttacagaagaagaatttcgaagatggttagatcttcttgctattcaaagcaaggtcataggcgtgggatttggacccctatggaggatatgattctctctgaatacnttcgaattcatggcagtgatggatggaaaaatatcgctaaacgagcaggtcttaaacgatgtggaaagagttgcagattaccgttggttgaactatcttcgccccgacattaaacgtggtaacatttctcctgatgaggaggacctcattattag

SEQ ID NO: 1736 - DNA, 464 bp, Pinus radiata
cagcatcgtggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttggcaatcgatggtcgcttatagcaggaagattaccaggtcgaacagacaacgaaatcaagaactactggaacactcatatgagcaagaagctgcttccattgaacgaatctcaacccaagactt

SEQ ID NO: 1737 - DNA, 361 bp, Pinus radiata
aaggaggcatcggcagcgttgttcctcctcctctcctctcctgcatttctcaaactcaaatacctctcctctcacaatcatggaaggcggagtcgtctttgaatctgtgcaaaacccactggatcgcctgaacactggaaatatggaccatggttgtgcccattacaggagacgatgtcggattcgggccccttgttgcaatgagatctatgattgtaggcactgtcacaatgaagccatgagccatctaaaggaccccttgctgcgccatgagctcccaagatacaaagttgaacgggttatttgttctctctgtgacactgagcaaaatgtcaagcaagtttgcgaaaactgtggtgtt

SEQ ID NO: 1738 - DNA, 371 bp, Pinus radiata
gcttttctgtttcattcgatttcgattgtgtagtgaagagcatggccgaacaggtcttggaagggagtcagccagtggatctcgagaagcatccttcaggcatcgttcccaccctccagaatatagtgtccactgtaaacttggattgcaaattggacttgaaagccattgctcttcaagctcgaaatgcagagtacaatcccaagcgttttgcagcagtcataatgagaataagggagcccaaaactacagcactgatatttgcatcagggaagatggtttgcacaggtgcaaaaagtgaacaacagtcaaaacttgctgcaagaaagtatgctcgtattatccaaaaattgggctttcctgctcatttc

SEQ ID NO: 1739 - DNA, 589 bp, Pinus radiata
gtctcagggtaacgaaaatggggaaggtgacaatatggctgcatggctcactggaataaacactcttcgcatccagcccttcaaacttccgcctcttggcccccatgatgcgaaggtgcgcatgaaggctgtgggtatctgtggcagtgacgtccactatttgaggacattacggtgtgcggactttattgtaaaagagccaatggtgattggtcatgagtctgctggaataattgaggaggttggcagtgaagtgaaacatctggttcctggtgaccgcgtagctttggagcctggaatatcgtgttggcgttgtgaccaatgtaagcgaggctcctacaatttgtgtcccgagatgaagttttttgcaacacctcccgtgcatggttccttggccaatcagattgttcatcctgcagatttatgtttcaagttgccagataatgtaagtctcgaggaaggtgccatgtgtgaaccactcagtgttggggttcatgcttgtcgccgtgcttctgtaggccctgagacaaatgtcttggtaatgggggcaggtcctatcggccttgtcaccgtgctgtctgcacgtgca

SEQ ID NO: 1740 - DNA, 473 bp, Pinus radiata
ctttgccgtgttcggttcgtattcagggtttcgggagcttgttgtgtggtgttctgcaggtcaggacattgtaggcctggttatacaagatttcgaagcaaactctcggagcctcgaagaatcggcgcaaatttcaacggccttataactatttgggaagcagtactctggatttttctcccggaacggatcggagtgtgggaagcgtaataatcgcctggaatttgtcttctgcaagataatattcaattaatctattgtcgaaggaaatttgagccgtataagaggataatcaaaagaagccggttgatttctccgggattaaaggatggatcaagaaaactggaacatcggagctgatggcactggctgccaagctccagaagggcacactctttgcgccaataactgcggcttttttggcagttcggcaacgagaaacctgtgttcgaaatgttacagggatctgatta

SEQ ID NO: 1741 - DNA, 546 bp, Pinus radiata
atccaaataatacaactatctttgtgggtggcttagacccaactgtgacagatgatatgctgagatcattatttggtcagtttggagaacttgtgcatgtcaaaataccagtgggaaaacgttgtggatttgttcagtttaataacagggcttctgcagaggaagcattgcaaatgctgcatggtacagttcttggtcagcaagccattcgtctttcctggggacggagtcctgcaaacaaacaaactgctgggtgggttcaaccccaacaaccagatccaaatcaatggaatggagcttattatggttacggacaaggatatgatgcaggttatggttatgcaccacaacctcaggatcccaatatgtacagttatgccccttatgcatatggaaattatcagcagcagtaacatttacttgggttcaggctcttctgtggacgtggaaatatgggttcattcatagagctgtctctgtaaacagttgtttttaacgggcatccagtcaacttatctatattaaatttaatgaagaggaaagtct

SEQ ID NO: 1742 - DNA, 348 bp, Pinus radiata
agcaacctacgcttgagcagccgaatgcgaagcacccatcgattccgcttccctcggcgttggtgccctcaagtagcgacgttccaatggtggaagcagtagcagcagcggagacggccattggcaccgctccatccagctcggcagaacaggaggtggagaaacatgaacaggacgaggaggaacagctgaggaagagcaagaagaggtgttttgcgtgtaacaggcgggtggggctgacgggctttaagtgccgctgtggtgaccttttctgcgctcagcacaggtactctgatatgcatgactgctcttttgactacaagactgccggccgcctcgccattctca

SEQ ID NO: 1743 - DNA, 300 bp, Pinus radiata
  misc_feature (1)...(300): n = A,T,C or G
cgaccatgcttcaagtgctgtcatggtggttgtgtcatcagcccctcaaattatgntgctcatgaaggcaggctatattgtaggcatcatagctctcaactttttagggagaaaggtaacttcagccanctttcaaaggcaacacctacaaaaggggtgactgataactcagacacagacnacaagtgatcattcgggccagatttttgctgacagagttgtagtgtgttattgattcatttcatacatttgatatgcaagcctgtacaatatcctgtgactgttaaaggcattcttttg

SEQ ID NO: 1744 - DNA, 355 bp, Pinus radiata
ggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttggcaatcgatggtcgcttatagca

SEQ ID NO: 1745 - DNA, 294 bp, Pinus radiata
attgcttgaaagagatgcacgagcatcttcaatttgcttgtccagtgtgctccaaatctgtctgtgatatgtctaaattgtgggagaaacttgaccgagaggttgctttgactccaatgcctgaagcttaccagaacaaaatggtttggatcttatgcaatgattgtggagtaacttctgaagtaaattttcacattgttgcacacaagtgtcaaagttgcaattcttataacacccggcagaccaggggaggtccttctgcaagttcatgtagatctcatctttgatattctc

SEQ ID NO: 1746 - DNA, 316 bp, Pinus radiata
  misc_feature (1)...(316): n = A,T,C or G
aaccgcctcttcttatactagtgcctttatcggnnccattcaaacttgctcacggattccgacccttccggctaaagctgctgcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctca

SEQ ID NO: 1747 - DNA, 263 bp, Pinus radiata
gtggctgttcccaggagaggagagcctcagctgtctcgatctggcgttaaggggttacagaagaagaatttcgaagatggttagatcttcttgctattcaaagcaaggtcataggcgtgggatttggacccctatggaggatatgattctctctgaatacattcgaattcatggcagtgatggatggaaaaatatcgctaaacgagcaggtcttaaacgatgtggaaagagttgcagattacgttggttgaactatcttcgcc

SEQ ID NO: 1748 - DNA, 145 bp, Pinus radiata
  misc_feature (1)...(145): n = A,T,C or G
ttcggtcggagaattgtgggtgggagccccaccggaggagtganggaaactcaagagatgttggacttttgtgcagagcataacatcagttgcatgattgaaaacattgcaatggattaccgtgaacacagcaatcgaacgatta

SEQ ID NO: 1749 - DNA, 206 bp, Pinus radiata
  misc_feature (1)...(206): n = A,T,C or G
ctggtgtgaatcacatcggagatggcattcgcaggaacacagcanaagtgcaaggcatgcgagaagacggtgtacgtggtggatcagctcacagccgatggttcagtctttcacaaggcctgcttccgctgccatcattgcaatggcaccttaaagctcagcaactattcttcttttgaaggggtgctgtactgcaaacctcactt

SEQ ID NO: 1750 - DNA, 263 bp, Pinus radiata
gttaaatttgaccccttcaatgcgttttatggttcagcctctatgttaatttgacacagtgagctgaaatattgcggctggatgtgtacattcacgactatctcataaaacggaatcttcttgcatctgccaagacatttatgacggaggcaaaagtttctccagaaccagtcgcaattgatgcacctggaggctttttgtttgaatggtggtctgtgttttgggatattttcatctcacggacaaatgagaagcactctgag

SEQ ID NO: 1751 - DNA, 321 bp, Pinus radiata
ccaatatgggggcagatagtatggttcctgttcacactcctgaagttattgagcattcttctacaaaagtttctattgatacagctgggtcaatggatgtggatgcagcatccaagtgcaatcacgtttacagaactacatctctcaaccactgtgtctcttcctcccccatagatgttggaattgtacctgacagcaacattacatctgatatttcaacaccttaccatgacccaagaggagtattcgagattcctcctcgggttgttcatcctggaggccaaggtgaggtcatgggaagagaagcaagagttctcagat

SEQ ID NO: 1752 - DNA, 316 bp, Pinus radiata
cggcccgagcaattttgcttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgccctgatctgaaacgaggaggtttttctgaagatgaagacgatcttattctcaaactgcacgccctcctcggaaataagtggtctctgatagcgggtcg

SEQ ID NO: 1753 - DNA, 335 bp, Pinus radiata
attgagtaaaacttcattcagttggattctcatcgttttcatggcttacaacccgcaaacatgccgccgccgccaccagcccggacagcagcctgggctcagacaacgagtccggcggcggaggaggaggcggcggaggagaagggcagtcgacgaagaatggcaatggcaactacattagagagcaggatcgcctgctccccatagcgaacgtggggcggataatgaagcgggcgctgcggggaatgcgaaaatctccaaagacgcgaaggagacggtgcaggaatgtgtgtcggagttcatcagcttcattaccggcgaggcctctgacaagt

SEQ ID NO: 1754 - DNA, 349 bp, Pinus radiata
  misc_feature (1)...(349): n = A,T,C or G
cacacagaagcttgtccgatggcgatcacgcaggggaaatggctacaggtgaatcagaaggaaggggggccaaaagcgcggagctcccatgcagttgcagtggtgggaaaaaaggcgtatgtgttcggtggagaggtggagccgcgcgtgccagtggacaatttgatgcatatcttggatctggaggacaattcctggtccgtggcggatgccaagggagaggcaccgcctcccagagtgggggtcaccatggtccctatcggctctgttatttatctcttcggtggtcgagaccagcatcacaaggagctcaaccatttctattccttcgatacnaattcctgccagt

SEQ ID NO: 1755 - DNA, 289 bp, Pinus radiata
  misc_feature (1)...(289): n = A,T,C or G
tcttaatgccctaaaggagcccagcaagaagatcgacggccgcatgactgtcagtcagttggcctctgctggttcacagcctgcccagccggcggctgatgtatctgcccggaaaatctatgtcgggaatgttcccatggacatggcggcagatcgcctgctgagccttttttctcagtatggagagatcgaagaggggccactagggtttgataagcaatcgggcangtcaaggggttttgcgctttttattttcaagtcangtggacgcaactaagcgtgcgttgga

SEQ ID NO: 1756 - DNA, 235 bp, Pinus radiata
agagtatgatcctgttgctaaaatttcaatcattcctcgtggacaagctggaggtctgacattctttgctcctagtgaagagagactggaatctgggctttacagcagaagttaccttgagaatcagatggcagttgccctcggtggaagggtggcagaagaagttatttttgggaaagaaaatgtcacaacaggagcatcgaatgacttcccacaagtatctcgtgttgcccgg

SEQ ID NO: 1757 - DNA, 457 bp, Pinus radiata
gtaggatggaaggcacgggtaagagattcaaagggaaggtggcggtggtgaccgcttcaacacagggcataggattcgccattgcacagcaccttggcctcgaaggtgcttccgttgtcgtctcttcacgcaaaaagaacaatgtagaggaagcagtggaaaagatgagagccaaagggattgatgttctgggagtggcctgccatgtttccagtcgagaacagaggagggatctcatccaaaagactgtagataaatatggtcacatagacattctggtctcaaatgcagctgctaatccaactgtgaagcccattgttttagttccagagcctgtacttgataaaatttgggagattaatgtcaaggccactattcttcttgtccaggaagctgctgctcacttgtcacaagagtcatcaattatcataatttcatcagttgctgcttacagacc

SEQ ID NO: 1758 - DNA, 345 bp, Pinus radiata
catgtctttgattcgggcaagcagacatggagtaagcctatggtgaaaggaaccccgccctctcccagggacagccacagctgtaccactgtgggaacaaacttgtttgtatttggtggcacagatgggaagaaccctctacgggatttgcatatgctggacactactacaaatacatgggtgcaacctaacgtaagtggtgaaggaccggcagctcgtgaggggcacagtgctgcactcattgatcaccgtctttttatatttggaggttgtggaaaagttcaagatgaatctgaagagatatattacaacgacctttacatactagacacagttaacttaatt

SEQ ID NO: 1759 - DNA, 544 bp, Pinus radiata
gagcaacccacattgcattgattgcactacagtttcagcgattttcaggtcatctcaggtgtgcagcttaagcttattctcttgaaaatatggctgaggaaggagagaaggtcatggtaaacgtttatgatctaagccaaggacttgctcgtcaactctcaactacttttcttggaaaagccattgaaggaatttggcataccggtgtggtagtttatgggaaggagtattactttgggggtggtattcaacacagccctacagggcaaactccatatggaaaaccgtggaaagtggttgagttgggtgtcactcacgttccgatggaaatgtttgaagaattcctggaaaaaataagccctcgctatacagcttaaacatatagtttggtgcaccataactgtaacaacttcagcgatgaggttgcacagtttttggttggctgcaacatcccagatttcatccttaggctcccacaagaagtgatgaacagcccaatgggccctttaataatgcccatgataatgcagtttgaagctactct

SEQ ID NO: 1760 - DNA, 375 bp, Pinus radiata
  misc_feature (1)...(375): n = A,T,C or G
cgatagccgagagcacccttatctcctccactctgtttcatacatgcaacaagctctggcagcagcaatggcggcccagactatcatcgctgcctctatggcatctcctctaacattatcaaatggccactatccgtttcagtccgagttcaaggggtccgtggttcgaatcccgcagagggcattttccttcgcgcctgcagcccgggcgctgaccgtcgtcgcanaggccaagaaggccgttgccgtgctcaaaggaaattcacaggtcgagggtgttgtcaatctctcgcaggaagacaacggtcccacaacagtgaaggtccgtttgacaggactgactcctgggaagcatggctttcatctacatgagtt

SEQ ID NO: 1761 - DNA, 333 bp, Pinus radiata
tttatatttttacaatccgaggttgcagggactttcagagaggtcgataccgtggaaaagactgagattgacggatcgattgcaatggcgtttgcggaagagtattccgatcgcgatgccgtatttcaaaagctgaaggcgaagtctgaaaacaagatttgttttgattgcaatgctaaaagtcccagttgggccgtccgtgacatatggagtattcatttgtcttgattgttcagcaatgcatcggagtcttggtgttcatgtcagttttggaggtctacaaatctcgatacatggaccatggagcagttgaaattgatgagctttggtggt

SEQ ID NO: 1762 - DNA, 331 bp, Pinus radiata
  misc_feature (1)...(331): n = A,T,C or G
ctcgtgcccgactataggccgcaccaccctcagccgtttcttctttgcctctcttcttcttgtgggccatgtgacctatggcctattcattttctgcactggatctgagagcgagggggaagttaacgagagccctggctccacgaattttgaaggcggcgcggncatatgcgagagcagcctcttcggcggtgatgaaagngccgagccaaactctggtcctcttggcggggtctctgatttcagctgcgaatttaccccacggccgctgccggactcctctgtagcgcctagctccgctcatctgcttcatctctccactctgctcttc

SEQ ID NO: 1763 - DNA, 568 bp, Pinus radiata
ccggccgccccctccgacctgcctgatggaacacagtggcgctacagcgagttcttgaacgccgtgaagaagggtaaggtggagcgcgtccgcttcagcaaggacggcagctacctccaactgagcgccgtcgatgggaggcgtgccactgtaaccctgccaaacgacccggacctggtggacatccttgcgatgaatggtgtggacatatcggtttccgagggggaggcgagcaatggcctcctcagcgtaatcggtaatcttttattcccaattttagccttcgggggtttattcttcttatttcggcgggctcagggaggccctgggggtcccggaggtttgggcggccctatggacttcggtcgctctaagtccaagttccaggaggtgccggagactggagttacatttgccgacgtggcaggcgctgaccaggccaagctggagcttcaggaggtggtggatttcttgaaaaaccctgataagtatactgcccttggtgccaagatccccaagggatgcttgttggtaggtccgccggggacgggcaagactctactggccc

SEQ ID NO: 1764 - DNA, 351 bp, Pinus radiata
gagaaggaagctgctcttgctgccacaccaccagaagatgataaacctacaatatttgacacaatactgcagaaggagattcccagtacagtggtttacgaggatgagaaggtacttgcattcagggatatcgcaccccaagcacctactacatcattatcatccccaaagtaagggatggcttgactggcctatctaaggcagaagagaggcatgaggatatttaggtcacctgctatacactgcaaaagttattgcaaagcaggaaggtttatctgatggcttcagaattgtcattaacgatggtcctactggatgccaatctgtgaccatttacatattcatctactc

SEQ ID NO: 1765 - DNA, 462 bp, Pinus radiata
tgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttggcaatcgatggtcgcttatagcaggaagattaccaggtcgaacagacaacgaaatcaagaactactggaacactcatatgagcaagaagctgcttccattgaacgaatcttaacccagactttgcctgtccccaaaaagaggtcgcaatcttcttctccctgc

SEQ ID NO: 1766 - DNA, 532 bp, Pinus radiata
  misc_feature (1)...(532): n = A,T,C or G
gtaaaaatgaccacggcgtggacttctggaacnccccggagcgttcaggatggttgatgaagcagggcgagtacatcaaaacatggaggcgcagatggtttgttctaaagcagggaaagctcttctggttcaaggaaaattacatcacaagggattctaatccccgtggtgttgttccggtgagcacctgcctgactgtcaagggagccgaagacgtcctcaacaagccattcgccttcgagctctcgacgagcagagagaccatgtacttcatcgcagacagcgataaggagaaggaggagtggatcaattccatcggccgctccatcgtacagcattccaggtcagttacagacaaggagatcgntgattatgatagccagcgtgccgataaatgaatacccaattcgaatcggatggattcgctgtaaattggttgcaattagggtttctaggggtttcttttgaattttgtgatggaacgccttaaatcggttgtccattgcatttctaggatgaatcttaataaatt

SEQ ID NO: 1767 - DNA, 354 bp, Pinus radiata
aaccgcctcttcttatactagtgcctttatcggttccattcaaacttgctcacggattccgacccttccggctaaagctgctgcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcaaggctgatgcgctgcgggaagagctgcaggctccgatggataaactacctgcgtcctgatctgaagcgtggaaacttctcagaagaagaagacgaactcgtcagtaaactccacttcct

SEQ ID NO: 1768 - DNA, 430 bp, Pinus radiata
cttcgacggcgcgatagccgagagcacccttatctcctccactctgtttcatacatgcaacaagctctggcagcagcaatggcggcccagactatcatcgctgcctctatggcatctcctctaacattatcaaatggccactatccgtttcagtccgagttcaaggggtccgtggttcgaatcccgcagagggcattttccttcgcgcctgcagcccgggcgctgaccgtcgtcgcagaggccaagaaggccgttgccgtgctcaaagggaattcacaggtcgagggtgttgtcagtctctcgcaggaagacagcggtcccacaacagtgaaggtccgtttgacaggactgactcctgggaagcatggctttcatctacatgagtttggtgacacaaccaatggctgcatatcaacaggagcacatttta

SEQ ID NO: 1769 - DNA, 407 bp, Pinus radiata
gaacgaacggtgaagatacacagaggatctctcaacggcttcatctccgtcgtcgtctctcctccttccatctccagcgtccgatctgatcttatcaaaggaagcccttaaatccctccagctttccaagcgcgggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggaatttatcagcttcatcaccagcgaggccagtgacaaatgccagcgagaa

SEQ ID NO: 1770 - DNA, 347 bp, Pinus radiata
cagacttttgctccgaactgttctggtgaaacaaaatccagtattgagctaggtttagaatcgggtttgctggtcatctgggagaggcgatccattcagcttcgcaggcccccgaagatggcgttcgccggcacaacccagaagtgcaaggcatgtgaaaagacggtctatttggttgatcaattgacagctgataattctgtttttcacaaatcctgtttccgctgccatcactgcaatggaactttaaagcttagcaactattcgtcgtttgagggagttctatattgcaaacctcattttgaccagctgtttaagagaacaggaagtttggataaaagttttga

SEQ ID NO: 1771 - DNA, 469 bp, Pinus radiata
cgatagccgagagcacccttatctcctccactctgtttcatacatgcaacaagctctggcagcagcaatggcggcccagactatcatcgctgcctctatggcatctcctctaacattatcaaatggccactatccgtttcagtccgagttcaaggggtccgtggttcgaatcccgcaaagggcattttccttcgcgcctgcagcccgggcgctgaccgtcgtcgcagaggccaagaaggccgttgccgtgctcaaaggaaattcacaggtcgagggtgttgtcaatctctcgcaggaagacaacggtcccacaacagtgaaggtccgtttgacaggactgactcctgggaagcatggctttcatctacatgagtttggtgacacaaccaatggctgcatctcaacaggagcacattttaatccaaaaaaattgacacatggtgctcctgaggatgatgtacgccatgcg

SEQ ID NO: 1772 - DNA, 461 bp, Pinus radiata
tcttacccttttcctgagccaccgagaatttcctctccggaatacccacttctcagagattcttgctgcgaactctgttttcttcagcgagatttgtcagtgaattgtgaggagtattgagtcttatcatgcggatccagtgcgatgcctgcgagcaggcaactgcttcagtgatatgttgtgcagacgaggctgctctgtgcagggaatgtgatataaaagtccacaaggccaacaagcttgccagcaaacacaagagattatctctcctcgaaacttctcgaaagctctctcgctgcgacatttgccaggatagggccgccatcgttttctgtctcgaagatcgtgctatgctgtgccaagactgcgatgagtccgttcattctcgcgacacattagcagcaaaacaccaaaggttcctggccactggcattagggtaggtctcaatgccctgtcatca

SEQ ID NO: 1773 - DNA, 332 bp, Pinus radiata
gacaatatggctgcatggctcactggaataaacactcttcgcatccagcccttcaaacttccgcctcttggcccccatgatgcgaaggtgcgcatgaaggctgtgggtatctgtggcagtgacgtccactatttgaggacattacggtgtgcggactttattgtaaaagagccaatggtgattggtcatgagtctgctggaataattgaggaggttggcagtgaagtgaaacatctggttcctggtgaccgcgtagctttggagcctggaatatcgtgttggcgttgtgaccaatgtaagcgaggctcctacaatttgtgtcccgagatgaa

SEQ ID NO: 1774 - DNA, 322 bp, Pinus radiata
ctcctgtgcagcgtacgccttcgcctttgcgatttcgagccccattggaattgccattggaatacttattgacgccactacagagggccgagtggcagactggatttatgcaatctcaatgggttttgcgtgcggtgttttcgtttatgttgccatcaaccatcttctgatgaaaggattaatacagaaccctctgaaaggtgtgattcgctttgacaaacccttttacaaatatttggctgtactcactggagctggactgattgcagtggtaatgatttgggacacctagtggtaatgaattgggacacttcttagctgc

SEQ ID NO: 1775 - DNA, 428 bp, Pinus radiata
  misc_feature (1)...(428): n = A,T,C or G
gagagagagagagagagagagagagagagagagagagactcnngccganttcgnnacnagcgaagccngtttccaaanatggatngggagaaactcatgaagatggctggtgcagtccgcactggcggaaagggtacaatgcgaaggaaaaagaagacaattcataagactgccacggcagatgacaagagacttcaaagtaccttgaaaagaataggcgtgaataacatccctgctattgaagaagtcaatatttttaaggatgaccatgttattcattttgctaacccaaaggtccaggcttctattgctgccaacacatgggtggttagtgggtcatcgcaaacaaaaaaacttcaagatcttttccctggtatcatcaatcagcttggaccagagagttttgccaatctgaggaagattgcaga

SEQ ID NO: 1776 - DNA, 512 bp, Pinus radiata
ataaaaccctaaatctctgcactcgccagctacgatttattctgcctccagcattttggtccttaccagtttgggcctctttttgcggtttctacacatagccgctgcgattctggggagtttctttggcttagatttttggggtaaaattctgggtattgtggtttgctcacactaattatcctgtcatggatcatcaacagcagcagtggatgatgcagcaacaaactcaacaacagtatcagcagccgcagtattcgaatgacgaaatccggacactttggatcggggatttgcagtattgggtcgatgaaaattatctccatacttgcttttcgcaaaccggagaggttgtgtctataaaggtgattcggaacaaggctacaggctatccggaaggttatggttttgtggagtttatttcccatgcagcagctgagaggattcttcaaacatacaatggtacacagatgcctggcacagagcaactttatagattaaattgggcttcc

SEQ ID NO: 1777 - DNA, 498 bp, Pinus radiata
ggatggaaggcacaagtaagagattcaaagggaaggtagcggtggtgaccgcttcaacaagggcatagggttcgccattgcagagcgccttggcctcgaaggcgcttccgtcgtcgtctcatcacgaaaacagaaaaatgtaggggaagcagtggaaaagctgagagccaaagggattgatgttctgggagtggcttgccatgtttccagtcgagaccagaggagagatctcatccaaaagactgtagataaatatggtcgcatagacattctggtctcaaatgcagctgctaatccaactgtggaccccattgtttcggttccagagcctgtacttgataaactttgggagattaacgtcaaggccactattcttcttgtccaggatgcttctgctcacttgtcacaagagtcatcaattatcataatttcgtcaattactgcttacaggccagaggcaatgatggccatgtatggggttaccaagactgctctttt

SEQ ID NO: 1778 - DNA, 435 bp, Pinus radiata
ggcgacacatggcccgtgtcaggcgccttgagaggccacaagcgtgcaattctatgcttggcgagtgttgcagaatttttatgcagtggatcggcggataatactattagaatgtggaaaaggggagaaggaaacaggcattactgtttggcggttttagaaggtcacagaggacctgttaagtccatcgcagtgtctttagacactgtgaggggatgccacgtctacagcggaagcctggatcatgacattaaggtttggcgggttagttcaaataaaagcagttccgacgatcatgccgagggtgccaaccataacaatcgcttgaaaaccatacactcccctgaggaaagcgtttttcattcaaggcaaatttttggtatttcatgaaactgatgtagccatctacgtgtcaactaactacaatatgcctgt

SEQ ID NO: 1779 - DNA, 470 bp, Pinus radiata
gccatggctgcatttcgcagggttctgttgctgtatcccaggtccctggtcatatggcggaagctggcagcccgggcagccaggaaagtcctcgttccggggaacaaagcccccagtccagcgtgcgggagcaggacaggttcctacccatcgccaacattagccgcatcatgaagaaggcgctgccggccaacggcaagatcgctaaagacgccaaggagaccgtgcaggagtgtgtctcggaatttatcagcttcatcaccagcgaggccagtgacaaatgccagcgagaaaagaggaagacaatcaacggcgatgacttgctctgggccatgagcacgctagggtttgaagattatatcgagcccttgaaggtttacttgctcatgtacagagaggcggagggtgacaataagggatcttcaaaatctggagtagaccaatatggaaagaaagagtcaaatgtacat

SEQ ID NO: 1780 - DNA, 359 bp, Pinus radiata
attcgttcgttccaacaacagcgaagccgatttccaaagatggatagggagaaactcatgaagatggctggtgcagtccgcactggcggaaagggtacaatgcgaaggaaaaagaagacaattcataagactgccacagcagatgacaagagacttcaaagtaccttgaaaagaataggcgtgaataacatccctgctattgaagaagtcaatatttttaaggatgaccatgttattcattttgctaacccaaaggtccaggcttctattgctgccaacacatgggtggttagtgggtcatcgcaaacaaaaaaacttcaagatcttttccctggtatcatcaatcagcttggaccaga

SEQ ID NO: 1781 - DNA, 360 bp, Pinus radiata
cggcccgagcaattttgcttctctgctaaacgatgggaagagcgccttgctgtgccaacggtgacagaagcaagggagcctggaccaaggaagaggatgacaggcttacccaatatattcaggctcatggagaaggatgctggcgttctctccccaaggccgcaggtctgcttcggtgtggaaaaagttgcaggctgagatggataaattatcttcgccctgatctgaaacgaggaggtttttctgaagatgaagacgatcttattctcaaactgcacgccctcctcggaaataagtggtctctgatagcgggtcgtttgcctggtcgaactgacaacgagatcaaaaactactggaact

SEQ ID NO: 1782 - DNA, 141 bp, Pinus radiata
cttctgtggattttatcaagaactctttaactagtgttgatgatgataaaggttcttttgcaccaacaaatttcattgagcaggctgatgaattgatccgaaaagagctggtgtcattactagagcacgacaatgcaaaat

SEQ ID NO: 1783 - DNA, 370 bp, Pinus radiata
atttgagtggggtgttttcactagcagaagcagcaaggtcagttttccactacagtactgcaacttcctcctatttcccacctcctcaagcttacccttctgacttcagttcccatcctgtgaatccaccatccaaacagctcaatgacacaaccagattagcccaagcattgttctgataattataatcctgacagttatattttttctctctgcatgtcttcacgttttaatcagatacttggcaagatctcccaatagagactccaacagctcaggggccataggtgcaatcgaagggcaactgcagcagctgtttcatctccatgacgcaagggttgagcaggccttcattgatgcattaccagtc

SEQ ID NO: 1784 - DNA, 381 bp, Pinus radiata
tggttttgatttgagtagcgggtttataagtccgggatttggtggtttttaaatggggctaagctattcttaattttgttctgttgggtacagcagagatttgaaggggatttgaatttgaatcatggaagttgagtgctgcagccctcggtcttccgctcaggggtgtgaggttgacatgaagccaacgatggtggtggaagatacgcttaatcaaggacgcatgcaatatggatgttcacactaccgccggagatgccaaataagggctccgtgttgtaatgaagtctttgactgtaggcattgtcataatgaggccaaaaattcaatggatgtccatccacttgacagacatgatgtaccgcgccatgaagttcgaaa

SEQ ID NO: 1785 - DNA, 441 bp, Pinus radiata
  misc_feature (1)...(441): n = A,T,C or G
cacaggcagcagataatatgaggcacaagaattcgtgccaatttcgtttctttgcttactatttcttccttcttctttaacaaatggatatattctaatcagtgcgctggtaatttgcaggttgcagggaagggntgctgtgatcacaggaggtgccagtggaatcggagaggctacggccaagttgttcgtggagaatggagcgaaagtagngattgcagaccttcaggacgaccatggaaaccgtcttgctcaatccctcgctcccaacgcctgctttttccactgcgatgtctccaaagaggcggacgtttccgccctgctagacttggcgctggagaagcacggacgtctcgacatagtgttcagcaatgccggaatcccaggcgggttattctcgtccatggcagacgtcactgtcgaggatttggaaagggtcat

SEQ ID NO: 1786 - DNA, 435 bp, Pinus radiata
caataatgcaggagtccctcaattagtgctcaaccttgtgtttgtcttggaattgagcaggcttctggccaactggcttctgtcccctttctggatatcagaccatcaatatggcgttcctctggatcagcccctcgccaattggcccatcactcctttaactaatcctgctagtcttcgttattctggcctcatcttctccgcttctcttgcgccttctgcccctgtttcccccaaccctgcataccctgaccagcagagcgttcgtgagaatttgcccgccgtcttcgactatgggagtctcagtgctgatcgccaggaggtggttgtctgtattgtttgtttcaatgagttcgtgtcgcgggatcgagtgcgccggctagctaaatgtggccatgttttccatatggagtgtttggataagtggatcgacta

SEQ ID NO: 1787 - DNA, 323 bp, Pinus radiata
gttgttcattaagcatggagccaaagtcataatcgcagacgttgcggagaaagctggcagaaagcttgaggaatcactttctcccgctgtggcaacttacgtgcactgcgatgtgagcaaagaaaaagatgtgagcgcggcggtggatgtggccatggataagtatggccaactggacattatgtataacaacgctggaactaatgacagctttttggtgaagagcgtggtagagtatgatatggagcaattcgatcgagtgatgaatgtaaacgtgaaaggagtgatgcacggcattaagcacgccgcccgcgtgatgatcc

SEQ ID NO: 1788 - DNA, 359 bp, Pinus radiata
cccttatctcctccactctgtttcatacatgcaacaagctctggcagcagcaatggcggcccagactatcatcgctgcctctatggcatctcctctaacattatcaaatggccactatccgtttcagtccgagttcaaggggtccgtggttcgaatcccgcagagggcattttccttcgcgcctgcagcccgggcgctgacagtcgtcgcagaggccaagaaggccgttgccgtgctcaaaggaaattcacaggtcgagggtgttgtcaatctctcgcaggaagacaacggtcccacaacagtgaaagtccgtttgacaggactgacttctgggaagcatggctttcatctacatgagt

SEQ ID NO: 1789 - DNA, 350 bp, Pinus radiata
ggatagttgtgctccgaggaaagcattgaattggggataatggcggaaactgtcacatattcatggccggtgggtttcgtctgtttcgttctgacgatgttactacttcaactctacagaatagtgtggagggaggacagtcgaggctacaatttgcctcccggttccagtgggtggccattgattggagagaccttgagcttcatgcgagggattaattccatttctaaaccacgccaattcattcaagatcgagagcaaaggtatgggaagatattcagaacaaatttgtttggaagatctcgaatgattgtgtctgtggacccagaattcaacaagtatattctgca

SEQ ID NO: 1790 - DNA, 337 bp, Pinus radiata
  misc_feature (1)...(337): n = A,T,C or G
gatttaggtagggttttaaggaagaaagacgatccaagcagtgggtttttatcgagctcccacgcagtttgaagggtgtcgcagcagaagaagatcggattcgttcatcctcatcacaaaagatggatcgggataagcttatgaagatggctggtgcagttcgtactggtggaaagggtacagtacgcagaaagaagaaagcagttcacagagccacaacaacagatgacaaaaggctccaaagtaccttgaagaggttaggagtgaatactattcctgctattgaagaagtaaatattttcaangatgagatggtcattcattttataaacccaaa

SEQ ID NO: 1791 - DNA, 315 bp, Pinus radiata
gtttgccattgaagaccaataaataattattgtgaagcagcagcgttttaatcagagatccagcaagaagaggaccaggaaaaatcatttgcagaacaagaagataatccaagatgtcaagcacacgcagccctcagtgtgggtgcggagaaacttgcgcttgcgccgattgcaagtgtggagttgtgagtattgcgcctccatccgaccaaacaagtgggggacatgcatattgcaagtgtggagaacactgcagctgcaatccatgtaactgttcaaagattgacgagactgttagtgggaaatccttctgta

SEQ ID NO: 1792 - DNA, 376 bp, Pinus radiata
gttttatcatgcggatccagtgcgatgcctgcgagcaggcagctgcttcagtgatatgttgtgcagacgaggctgctttgtgcagggagtgtgatataaaagtccacaaggccaacaagcttgccagcaaacacaagagattgcctcttgtcggaacttccccaaagctctctcgctgcgacatttgccaggatagggcagccatcgttttctgtctcgaagatcgtgctatgctgtgccaagactgcgatgagtccgttcattctcgcgacacattagcagcaaaacaccaaaggttcctggccactggcattagggtaggtctcaatgccctgtcatcagaatctccgggctcaagcgaatttgacaaacagcc

SEQ ID NO: 1793 - DNA, 407 bp, Pinus radiata
gggaattcccattctgcacatgcaatggacaatggaatgatggtatggatagttttagcaggggtagtggcaatggcagtgtggtatcttttggtacagcaccaacagcctaagcagagccacaatgttccttgggagactcttccaccgggggctgtgggatggccctttctcggagagatcatctctttctatttccgaacaccggattttgtgaagcagcggcggggaaggtatgggaatttgtttagaacgttcctgataggatatccaatggtaatctcaacagatcctgaggttaacaagtttattctgaataatgatggccggctgttcgttcctgcatatccgtcgcattggtcacagataatcggagagtgcaatatctttgctgctcgtggagactt

SEQ ID NO: 1794 - DNA, 532 bp, Pinus radiata
cctgggtgccttcgtcgctcacttcacaatcaagttgaaagtgaaatcaatcgatctgaaggtgaaggtgaaggtgaagcgtattctcattcgcctcacaccgccatggacattacagcacggcagatgttgcagttgattcgccaccatttgctggaagaggaagacgaaatggatgttcttgaggtagggggaaattatccattctcctcatcatcatcttcattatccttctctcccacagtgagctccgatttttcccacgccactgccagtggcccatgccaaaccagcgacagcacatcattatcagaagagaatgagagtgcacaaccctcttctgcttcttcttcttgtgtatccactgttttacgaagcgcagaggcggtaaatgtaaaggtaatgccacagccacagccacaggaggaggacagtcgagagaccatcaaagacaggcactacagaggagtgaggaagcggccatggggtaaattcgcagctgaaatcagggaccccgccacgaagggggcca

SEQ ID NO: 1795 - DNA, 502 bp, Pinus radiata
tgcataccatcattgtaatggaggtgaaaggaataggagtgggattcttattaagcaatggaaggttacgctgcgaataacgatgcagaactttgagcaaaacccttcaagtggaacagaagttgttctatttcgatctcaaggaaaacccccgaggtcaataccttaaaatctctgagaagacctccggctcacggtctacaataattgtgcccattggtggagttgcatggttcctcgatctctttaattattatgtcgacggagatgacgaggaagttttgagcaaggaattgcagctggatgccaaggtattttatttcgatgttggggtgaataaaaggggtcggttcttgaagatttctgaagcatctacatcctacagtcgcagcacaatcattgtacctgtaggaaacacaagaaaagatggttgggcagcatttagaaatattttaggagagataaatgaagcttccaacaagcttctggcccatccgaacat

SEQ ID NO: 1796 - DNA, 476 bp, Pinus radiata
  misc_feature (1)...(476): n = A,T,C or G
cgaaactcgaatcgatatgctttgtggccggttcaaatatttgagcnggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggaggacgcgtcgctgcagaggcttgttcagaaatacgggccgaggaactggaccctgataagtaaaggaatcccggggcgatccgggaaatcgtgcaggctacggtggtgcaatcagctgagccctcaggtggagcacagaccttttaccccgtccgaggatgctgctattctgcaggcccacgcgcagcacggcaacaaatgggcaacaattgcccgagccctccccg

SEQ ID NO: 1797 - DNA, 509 bp, Pinus radiata
ttccagaccttttgcatcttcattattcttccgcctgtgaaaagatggggagatctccgtgctgtgagaaggctcatactaacaaaggggcctggactaaacaagaagatgaccgccttatcgctcacattcgagcccacggcgaagggggctggcgttctcttcccaaggccgcagggctgctgagatgcggcaagagctgcagactgcgatggataaactacctgcgtcccgatctgaagcgtggaagcttcaccgaagaagaagacgagctcatcatcaaactccactccttcgttggcaacaagtggtctttaattgcagggagattgcccggacggacggacaacgagataaagaactactggaacacacacatcaaaagaaaattgctgagcaagggactcgacccccaaacccatcgtccactaggccagccaaacaatacccccgtcactcggcctgttcccgagcacgaaattccggcattccagaaccctgcaacgccg

SEQ ID NO: 1798 - DNA, 247 bp, Pinus radiata
ccagactatcatcgctgcctctatggcatctcctctaacattatcaaatggccactatccgtttcagtccgagttcaaggggtccgtggttcgaatcccgcagagggcattttccttcgcgcctgcaagcccgggcgctgaccgtcgtcgcagaggccaagaaggccgttgccgtgctcaaagggaattcacaggtcgagggtgttgtcagtctctcgcaggaagacagcggtcccacaacagtgaa

SEQ ID NO: 1799 - DNA, 147 bp, Pinus radiata
tcattattcttccgcctgtgaaaagatgggagatctccgtgctgtgagaaggctcatactaacaaaggggcctggactaaacaagaagatgaccgccttatcgctcacattcgagccccggggaaaggggctggcgttctcttccca

SEQ ID NO: 1800 - DNA, 361 bp, Pinus radiata
cttcagtttgcattgaagaccaataaataattattgtgaagcagcagcgttttaatcagagatccagcaagaagaggaccaggaaaaatcatttgcagaacaagaagataatccaagatgtcaagcacacgcagccctcagtgtgggtgcggagaaacttgcgcttgcgccgattgcaagagtggagttgtgagtattgcgcctccatccgaccaaacaagtgggggacatgcatattgcaagtgtggagaacactgcaactgcaatccatgtaactgttcaaagattgacgagactgttagtgggaaatccttctgtaaatgtggagagaattgcgcctgtgaaacatgcacctgcagca

SEQ ID NO: 1801 - DNA, 359 bp, Pinus radiata
cgtggctgttcccaggagaggagagcctcagctgtctcgatctgcgttaaggggttacagaagaagaatttcgaagatggttagatcttcttgctattcaaagcaaggtcataggcgtgggatttggacccctatggaggatatgattctctctgaatacattcgaattcatggcagtgatggatggaaaaatatcgctaaacgagcaggtcttaaacgatgtggaaagagttgcagattacgttggttgaactatcttcgccccgacattaaacgtggtaacatttctcctgatgaggaggacctcattattaggttgcatggccttcttggcaatcgatggtctttgatagcaggac

SEQ ID NO: 1802 - DNA, 475 bp, Pinus radiata
agcgtctatagaagagcagggactaattccatctttctccatttctatttctcttcccaatcaaaaccatggcgtctaacggacagcttaatgcaggcactggctgtgttggtgatctgaccaatgttggagatcgacgattggaggggaaggttgcaatagtaacgggcggggcagcgggcataggagaagccattgttcagttgttcattaagcatggagccaaagtcataatcgccgacgttgcggagaaagctggcagaaagcttgagcaatccctttcacccgctgtggcaacttacgtgcactgcgatgtgagcaaagaagaggatgtaagcgcagcagtggatgtggccatcgacaagtatggtcaactggacattatgtataacaacgctggaactaacgacagcgttttggtgaagagcgtaacagagtatgatatggagcaattcgatcgagtgataaatgtaaa

SEQ ID NO: 1803 - DNA, 382 bp, Pinus radiata
attactttcagttttgcaagctggagatgactttgactgtccagtatgtttatcaccaccatcagaggctatcataaccatctgttcacatgtgttctgtaagaagtgcattgagaagacattgaaacatctaaagccacagtgtccattgtgccgtaagcagcttacagcatctgatctttttagttcaccaaaggttgctgacgagaatgaagttacatcagaaaaagtagccaaaactggttcaaaaattaatgcattaatagctctattgaaagagtcccaggatcatgatccaactacaaaatctgttgtattttcacaatttcgaaaaatgctggatctcttgcatgaacctttgaaaagtcaggcttctagtttg

SEQ ID NO: 1804 - DNA, 533 bp, Pinus radiata
atcgcctggaatttgtcttctgcaagataatattcaattaatctattgtcgaaggaaatttgagccgtataagaggataatcaaaagaagccggttgatttctccgggattaaaggatggatcaagaaaactggaacatcggagctgatggcactggctgccaagctccagaagggcacactctttgcgccaataactgcggcttttttggcagttcggcaacgagaaacctgtgttcgaaatgttacagggatctgattatgaaggaggcccaagcctcatctgcaatggccgccgttgagaagtcatttgccgcgggttctccgatggaggaggaggcccctctttccaagccagatgttttcgtcgaacaaagccgtgcaccgatctccccagccgtagtccaagcctcgtcagttcacttggctgatataggttcatcttcttctccacaacctcctgccgaaactcctaaccggtgcttctcctgcaggaaacgagtcggtctgaccggcttcaaatgtcggtgcgga

SEQ ID NO: 1805 - DNA, 549 bp, Pinus radiata
gagtgaggaagctgtagatgaaaagcgtgtaaatctgcagcaagcagaaggtccggaggagcccagggttgtaactgcgagcacattagaatccccaaaaagtacagaacaggagaatagtcttgaggttgaggaagctggtgacaaaaagctccaggcacatgtgaatgaaacgtctttgaatgcagatcaagaaaattccatcaaggagcttcacaacaagtatcctcgttactcggaagaacttttgacgaatatgctggctgatcaggatggcgatttgaaagagctagaagcactcttaaaaacattacaacgccaagagattagagctgctaatcgaaaaatgtcaggtccatcatcttcaaaggcaacagataacacagatgtttccacggaatcaccaccctcaaagctacagaatgcctctaagggcaaaaccagaggaaagagcgccaagaagagagaaagggatacaactttatccgtaggtagagttcacaaaacgcgtcgaaaaactgcttccgacgatgtgaaggccgcttctaa

SEQ ID NO: 1806 - DNA, 397 bp, Pinus radiata
gttttgggctctcatttgggagttacattcaaccaagctcatcacatggcgtccgagaaggaagctgctcttgctgccacaccaccagaagatgataaacctacaatatttgacaaaatactgcagaaggagattcccagtacagtggtttacgaggatgagaaggtacttgcattcagggatatcgcaccccaagcacctactcacatcattatcatccccaaagtaagggatggcttgactggcctatctaaggcagaagagaggcatgaggatattctaggtcacctgctatacactgcaaaagttattgcaaagcaggaaggtttatctgatggcttcagaattgtcattaacgatggtcctactggatgccaatctgtgtaccatttacata

SEQ ID NO: 1807 - DNA, 242 bp, Pinus radiata
caagatgggcagatcttcttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattc

SEQ ID NO: 1808 - DNA, 364 bp, Pinus radiata
  misc_feature (1)...(364): n = A,T,C or G
caagagtaaacccgaaggaatagaaggggaaggaggcatcggcagcgttgttcctcctcctctcctctcctgcatttctcaaactcaaatacctctcctctcacaatcatggaaggcggagtcgtctttgaatctgtgcaaaacccactggatcgcctgaacactggaaatatggaccatggttgtgcccattacaggagacgatgtcggattcgggccccttgttgcaatgagatctatgattntaggcactgtcacaatgaagccatgagccatctaaaggaccccttgctgcgccatgagctcccaagatacaaagttgaacgggttatttgttctctctgtgacactgagcaaaatgtca

SEQ ID NO: 1809 - DNA, 265 bp, Pinus radiata
cttaagtttcagatgcctggtaattcttcttttccaactggaaacgctgccccatcaactaaaaatctttactattcatttgacttgggagttgtacatttcttgtatatgtccactgaaactaattttttagatggaagtgatcaatatgctttcatagagcaagatttgaaaaaggttgatagaaacaagactccatttgtagtatttcaaggtcaccgtcccatgtatacgactaactatgaactaaaagatgcgcctctaa

SEQ ID NO: 1810 - DNA, 346 bp, Pinus radiata
cttgaatcgatcttgcctgcttgtgccggagcgcgcacagtgtgtggtttgttctcgtttttcatcttaaagcggcggttgcaggaattgattgtgtgaggggacgagatgtgtgcagaggtaagtcagagtgccatggccgtgcacactatgcagatggcgagaatggaaatgaagcgtgaaataggagtctgtgagcaggaagcttcgtcggccgtgaaggaaacgcatttcagaggcgtgaggaaaaggccgtgggggagattcgcagcggaaattagagatcccttgaagaaaaccagagtctggctaggcacttttgacactgccgaagaagctgccgagc

SEQ ID NO: 1811 - DNA, 353 bp, Pinus radiata
  misc_feature (1)...(353): n = A,T,C or G
cgaaactcgaatcgatatgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggaggacgcgtcgctgcagaggcttgttcagaaatacgggccgaggaactggaccctgataagtaaaggaatcccggggcgatccgggaaatcgtgcnagcttcggg

SEQ ID NO: 1812 - DNA, 185 bp, Pinus radiata
tcttgctgccacaccaccagaagatgataaacctacaatatttgacaaaatactgcagaaggagattcccagtacagtggtttacgaggatgagaaggtacttgcattcagggatatcgcaccccaacacctactcacatcattatcatccccaaagtaagggatggcttgactggcctatctaa

SEQ ID NO: 1813 - DNA, 337 bp, Pinus radiata
caataaatggccgaatgaattaatcaacgatgaaatgaattaatgaataagctattggatctaggaagggttttgaggctgaaagttttgggctctcatttgggagttacattcaaccaagctcatcatatggcgtccgagaaggaagctgctcttgctgccacaccaccagaagatgataaacctacaatatttgacaaaatactgcagaaggagattcccagtacagtggtttacgaggatgagaaggtacttgcattcagggatatcgcaccccaacacctactcacatcattatcatccccaaagtaagggatggcttgactggcctatctaa

SEQ ID NO: 1814 - DNA, 340 bp, Pinus radiata
gttcaagggagacgggatattcagagtccgatcgccgccatggccgtagacaccatacagatggcgagagtgggtgtaaaaatgaagatcggaggaggcggctgcgaggaagaggcgtcctcggctgtgaaggaaacgcatttcagaggagtgaggaaaaggccgtgggggagattcgctgccgagatcagagatcccttgaagaaaaccagagtctggctgggcacttttgacactgcagaggaggccgcccgagcctacgataacgctgccagaaattccgcggggccaaggcgaaaactaattttcttctgtctccccacaatgacattagcaccaa

SEQ ID NO: 1815 - DNA, 433 bp, Pinus radiata
ccgctatcctttccattacatcccacgttaggtcacggtttcgaacccttgcacggccattcttctgttaagatggtgagatctccctgctgcgacaaggttcataccaataacaaaggcgcctggaccaaagaagaagacgagcgtctcatagcacacattgaagcccacggcgagggctcatggcgttctcttcccaaggccgcagggctgctgcgatgtgggaagagctgcaggttgcgatggataaactacctgcgtcctgatctgaaacgcggaagcttttcagaagaagaagacgatctcatcatcaaactccactccctcctcggcaacaagtggtcgcttattgcagggagattgccagggcgaacggacaaccgaaaataaaaaattactggaacacgcacatgaaaaggaaattgttgagcag

SEQ ID NO: 1816 - DNA, 225 bp, Pinus radiata
atcacagtcggcctctgatcaaagaagaagccgaatcaaggtgataattctgcaaattctgcagatgtagaaactcttcttcctcaggttgatgaaacagcttctgctgatctgacagtgttcccaggttttgttaccccttatgtaccatacgggttccccatatggcacacttttagacccacaataactcaaacttccaatgtttataagccaacagctgta

SEQ ID NO: 1817 - DNA, 337 bp, Pinus radiata; identical to SEQ ID NO: 475

SEQ ID NO: 1818 - DNA, 390 bp, Pinus radiata
gtttgttcgaacgatgaaaaccagctaaaacaaagcgcagggattggcaggattcgagcagtggtccttggggcggagttgatagaagaagaagaaacctaccatatacacatacatatattatatacatagacacatgggggctccgaagcagaaatggacttccgaagaggagggagctctcaaagcaggtgttgagaagtatggcactggcaagtggcggaccattcagaaggaccctgagtttggacactgcctcgccgctcgttccaatgtggatttgaaggataagtggcgcaatatgagtgtgagtgctagtggccaaggttcaagggataaggtaaagactccaagagtaaaagctattgcctctctgccttattcatcaag

SEQ ID NO: 1819 - DNA, 367 bp, Pinus radiata
attcaaaatgggaaagaagttggagctgaaacgcatccaaaaccctaatagttcacgtgattccttctccaaatgcaagaggggactgctaaagaaatcggtcaagctctttgttctctgtgatgctgaagtttccctcatcattttatctgaaaccgccaagatttacgagtttgcaagcaacaagtcgtgactagctcttgtgaattcttctgatcaagttagagatccatatactgatatataaaagcatactttcacattgcaattggagcagatctagatgcagaagtgcaaccttattatacctaaaggccatcagctgcaaatcaagacccattttctatcttttgagatcgtgatacag

SEQ ID NO: 1820 - DNA, 487 bp, Pinus radiata; identical to SEQ ID NO: 534

SEQ ID NO: 1821 - DNA, 319 bp, Pinus radiata
tttaagcatttcattgagtcttaggtcacggtttccaatcctggcaggtctcattattctgtctctctggcaagatggggagaactccctgctgtgaaaaaggtcatacaaacaaaggcgcgtggaccaaagaagaggacgatcgcctcatcgctcacattcgagcccacggcgaaggccgctggcgttcgcttcccaaggccgcagggctgatgcgatgcgggaagagttgcaggctccgatggataaactacttgcgtccagtctcaagcgtggaaacttctcagaagaagaagatgagttcatcatcaaactccac

SEQ ID NO: 1822 - DNA, 320 bp, Pinus radiata; identical to SEQ ID NO: 507

SEQ ID NO: 1823 - DNA, 338 bp, Pinus radiata
gtcgagctccttgctgcgagaaaacccatacaaacaaaggcgcctggagtaaagatgaagatgaagcactcgttgcatatattcaagcccatggagaaggcagttggcgttcccttcccaaggccgctgggttgcagcggtgtggcaaaagctgcaggcttagatggataaattatctccgtcctgacctcaaacggggcaatttcagcccagaagaagatgagatcattatcaaacttcattctatgttgggtaacaagtggtctttgatcgcaagcaaattgccagggcgaacagataatgagataaagaattactggaacactcacattaagaga

SEQ ID NO: 1824 - DNA, 332 bp, Pinus radiata
gccgaggtgaggaggcattacgagcttcttgttgaggatgtgactgtgattgagtctggccgggttgctttgcctgcttattctgaaaattcgtatacaccgcccgaattgatgtcagatcagttgggcgatctcacaaaacagcaggcggtttctgtgaaggctccctcggccaaggcatccgaacaggagcgcaaaaagggcgtgccctggactgaagaagagcacagactcttcttgatgggattgaataaatatggcaaaggtgattggagaagcatatcaagaaactttgtggtctcacggacacctactcaagttgcaagccacgc

SEQ ID NO: 1825 - DNA, 301 bp, Pinus radiata
accgtcgagagagcttcatatctaaccaataataacacctgtatggcttcatagcttcacagcaacagggcaccatgggccgagctccttgctgggataaaatgggagtaaagaaaggcgcctggactctagacgaagataaaatactcgtcgattacattaccaaacatggccatggcaactggcgcgcactgcccaagcaagcagggctcctgcgatgtggaaagagttgtcgcctgcggtggacgaactacctgatacccgacatcaaaagagggaattttattccagaagaggaata

SEQ ID NO: 1826 - DNA, 498 bp, Pinus radiata
tttgcatccaattcttcctgtatcatctaattgctcagtctagcaattacgcaatctcggtccccagtcatgtctgacgaagaggttaatgcaactgctgcctctgtgggcaatctgaccttgctgctgcatgcatctcagcgacgattggaaggcaaggtcgcaataataacgggcggagcatctggcataggagaaggcatcgttcggctcttcacaaagcacggagccagagtcataatcgcagacattgcagatgaaaccggcaaaattctggccgaatccctttcgcctccggccacttacgtgcgctgcgatgtgagcaaagagcaagacgtcagcgctgcggtggatttggccatggagaagtacgcgcagctggatatcatgtttaacaacgcaggaatcgtcgatacggttaatgtttcaaggggagtggcagagtacgagatggagcagttcgaccgagttatgagcgtcaacgtcagaggggtgatg

SEQ ID NO: 1827 - DNA, 551 bp, Pinus radiata
cgtggctcttcccggcagacctagtaagccgactactgtaaatttattcttttagggttacagaagaagaaaatacaagatgggcagatctccttgctgctcaaaagaagggctcaaccgtggggcctggaccaaaagggaggatatgattctctccgaatacattcgaattcatggcgatggcggatggagaaatatgcccaaaagagcaggtcttaaacggtgtggaaagagctgcagattacgatggctgaactatcttcgccccgacattaaacgtggaaacatttcccctgatgaggaggaactcataattcggctccatcgccttcttggcaatcgatggtcgcttatagcaggaagattaccaggtcgaacagacaacgaaatcaagaactactggaacactcatatgagcaagaagctgcttccattgaacgaatctgaacccaagactttgcctgtccccaagaggaggtcgcaatctccttctcccctgcaaaatcgagtctttaaagccaaccctgtgaaaataacaacggtggtcagtc

SEQ ID NO: 1828 - DNA, 256 bp, Pinus radiata
ctgaaattcggatgccgaaatcccatgagaagatatggctgggatcctataataccgccgagcaagccgcccgtgcttacgacgccgctgtgtattgtctgagaggacccgccgccaaactcaattttccagaaaccgtgccgggtattccgtctgcgtcttccctttcccggcagcaaattcagcatgcagccaccagatatgccttgggtgaaatccctttgatttcgccctctctgcaaaatattgactcgag

SEQ ID NO: 1829 - DNA, 372 bp, Pinus radiata
gcagattctcaacagaattgggaaagttttgtgaatattgaagatggctcagtgccatgaaatcattgaaagtcgttgcagagacagccatggcgcatcagatctgaagctgtttgccatggccgcggttctggtgacgagcaccggaggagtatgtttgccggttctgtttgccagatattcccgagggctcaaattttacggcactcttctggtactggtgaaatgtttcgctgccggagtgattctgtccacaggatttgtccacgtcatgccggaagccttccgcgctctggaaagcgactgcctgccggatcatccatggcaccagttcccgttcgccggactcgtggccatggccggggcaatcct

SEQ ID NO: 1830 - DNA, 486 bp, Pinus radiata
agcgggtggtgatttagccgagggcgaagaggaggacgaagaagggcttcgtaacaaacgtggcgattgatcctaccttagcctgaaaatgctgtcaggaggctacgcaaccagatccgacactactactgtcaacaacggatccgctaatggcccaataggaagtgctcccccaagaattaactcgatacaaaataataatccaggagctgtcaggcctggctggggaaccatgccccttcacatgaatccttatcatccccaatcaatgcctcttccgccccccaatggtatgcagggtcagcttgtttgcagtggatgtagaactcttcttgtttatccgcaaggtgcaccaaatgtttgctgtgcagtatgcaacacagtcactccagttccacctcctgggacagaaatggctcagctaatctgtggacgttgtcgtacattgctaatgtatgttcgtggagcaactagtgttcagtgctc

SEQ ID NO: 1831 - DNA, 330 bp, Pinus radiata
gtttttccgcaggaagttttgatttgagtaggaaatcctttggcctcctggagctttgatttgctcaggaaaccctagcccttcggttcctgaagctttgcttttcgtaggaaaccctttggcaccggtaggcgatggctcccagcaacaacagaagagacgacaatggagcacgaggagttcacttcaggggcgtcaggaagaggccctggggtcgatacgcggcggagattagggatccatggaaaaaagttcgtctttggctcggcacctttgacacggccgaggaagccgcccgggcttatgacactgccgctatctccctcagag

SEQ ID NO: 1832 - DNA, 413 bp, Pinus radiata; identical to SEQ ID NO: 584

SEQ ID NO: 1833 - DNA, 260 bp, Pinus radiata; identical to SEQ ID NO: 351

SEQ ID NO: 1834 - DNA, 338 bp, Pinus radiata
aattgaatcggccatggttttgtatgaattgttacatgtacagcagattcagcaaatacagcagcagcagtttcaattgcaacaacaacaaatagcagcagcggcttcaatccaccatatgggtcgaaaccctctgggtcccagagctcagcccatgaaacttcatggcagcagcctatcaaagccggctaagctttacagaggcgtgaggcagcgccactggggtaaatgggttgcagagatcaggttacccagaaacagaaccaggttatggctggggacttttgatactgcagaggaagcggccatggcttatgacaaggctgcttacaggctga

SEQ ID NO: 1835 - DNA, 240 bp, Pinus radiata
gcttattggaatgcctgacactaactatggaagcgaacagacaaatgcttgcaaaaaacagaaaagaatacgttccaaggattcaggagaagatggtgaagatagacagagataacatcctttcattgttactgagcccggtgaacttgcaagagggaaaaagaatgggttagactatctctttgatctttatgaacagtgcgggaaatttctgctggatgtgcaacatattgcgaagga

SEQ ID NO: 1836 - DNA, 349 bp, Pinus radiata
gataaatccagatgaggttttagcagtcaactttgcattccaactgcatcacatgcccgatgaaagtgtgtctacaaagaacctacgtgaccggcttctaaggatggtgaagtctctcaaccctaaagtggtcacagttgtagaacaagaggttaacactaatactgcacctttcttaccccggttcatggaagcattaaactattactcatcagtgtttgagtctctagatgctacaattccaagggatagtagagatcgtatgaatgttgaaaaacagtgccttgcccgagacatagtgaacataattgctttgtgagggggaagaaagggttgagaggtatgaagt

SEQ ID NO: 1837 - DNA, 457 bp, Pinus radiata
gaaaagtatgttcaagttttttccattcaaacatatccttgttggagggattcggaaccgtctccggtcgtcttcaaccagtctgaccccaactcgcagtctcttgtactctcaaagtataaatttttcaagaatggctaattcgaatcgaggatgcttcatatgcggttctgaggatcatcgaaaagcggactgtcccacacccgacaaacttacctgttatcagtgcggtggagtgggccatcagtctcgggactgctcttcctccgagaagcgcaaaacctgctacaaatgtggtgaagagggccatatctctcgcgactgttccaatgcgccaacctctgagtattccggtggtaattccggcaccgaatgttataaatgtggtaaattgggtcatatctctcgctcctgtccgacaaatgagtcaactgctgactatgctagggctcctagc

SEQ ID NO: 1838 - DNA, 395 bp, Pinus radiata
ctgaaatatcgttaaattcactcttttggtctcagttactgcgtcgccaatatggaaaatctccccaatcagcaacctgaccttgaaattgctcaaacacacgaggatcccgggtcccgccaatttaagggaattcgactgcgaaaatggggaaggtgggtatcggaaatccggatacccaaatctcgagagaaaatatggctgggctcttacacgactcccgagcaggctgcccgtgcttacgacgccgcagtgtattgtctgaaagggcccaacgccaaattcaactttccggaaaccgtgcacgacattccgtctgtgacttctgtttcccgtcaggaaattcagcacgcctccctcaaatatgccttgggccagccccctccgagtttgca

SEQ ID NO: 1839 - DNA, 395 bp, Pinus radiata
gctaacacagcccttatatatcatcatgggaagcttcttgcacttcaagaggcagataaaccttatgcacttagagtccttgaggatggtgatttgcaaactcttgggctaatggattatgataataaattagcacactccttcactgcacatccaaaggttgaccctgttacaggggagatgtttacatttggttaccaacacaagcctccctatttaacttaccgggttgttacaaaggagggaataatgcttgatccagttcctataacacttcccaaacctgtcatgatgcatgactttgccataactgataactatgcaatcttcatggatcttcctctctatttttctccaaaggatatggtaaaaggtggactcatcatgtcttatga

SEQ ID NO: 1840 - DNA, 468 bp, Pinus radiata
ctcatttcagtgattcactcactgaaattattgttagaatcactgttttggccccagagcttctgcgtcgccaaatatggagatacgcctccagcaggaaaacgaccaggacattgctccgccacacgaagatcgcgtgtcccgccaatttaaaggagtccgaccgcgtaaatgggggatatgggtatcggaaatccggatgccgagatctcgacagaaaatatggctgggctcgtacaaaaagcccgagcaggccgcccgcgcctacgacgccgcagtgtattgtctgagagggtcgaacgccaagttcaatttccccaattctgtgcccgacattccgtctgcgtcttctctttcccgccagcagattcaactcgctgccgccaaatatgcgttggatcagtccccttcaagcccgccgtctctgaacaataataaagaggaacccgcgtcaccgtcgcagtcgtc

SEQ ID NO: 1841 - DNA, 378 bp, Pinus radiata
aaacaatacagtcgacattgttgcagcatctagagctattcgtgaaccacgtgtagtggtacaaacaaccagtgaaattgacatccttgatgatggatatcgatggcgcaagtatgggcagaaggtggtgaaaggaaatccaaatccaaggagttactataaatgcacaaatgctggatgtccagtgaggaaacatgtggaaagagcatcacatgatccaaaagcggtgatcacaacatatgaaggaaagcataaccatgatgtgcctgctgccagaaacagcagccatgataatgctgcaaaagggaatggggcagctcctctagcaatgcagaataatgtcccagcgcctatgaatgctataccacgacctgttcc

SEQ ID NO: 1842 - DNA, 382 bp, Pinus radiata; identical to SEQ ID NO: 455

SEQ ID NO: 1843 - DNA, 314 bp, Pinus radiata
catagaaagagctttatgtgtcctgaatttgaaccctctcctcgttttaaagaatccgagctttgcaaacacgccttgagctagactccggaataccccagcaacaatccgacatggctaaatcctcgcaaaaccagaacccccgcaacagacgcgaaaaccgcttacggaagtcacggcagttcaagggaatacgaatgagaaaatgggggaaatgggtgtcggaaattcgaatgcccaattccactgggagaatttggctaggctcttatgacacgccggaaatggctgcccgcgcctacgattttgcccgg

SEQ ID NO: 1844 - DNA, 384 bp, Pinus radiata
ccggttcctagttcgaatccttgccctaacgcagtcccgtgttttaagactcaatctttagtgactcccccgcaacatggttaagcccttgccaaaacagagcagcccgagcggatcggaaaactgccaaataaagtcgcggcagttcaaaggaatccgactgagaaaatgggggaaatgggtgtcggaaattagaatgccgaattccagggccaaaatctggctgggctcctacgactccccggaaaaagctgcccgcgcctacgactttgcgttgtactgtctaagagggtcgaaggccacattcaattttcccgactccccgccggaaattccatgcgcctctgacctgtcgccgccgcaaattcaagccgccgcggccag

SEQ ID NO: 1845 - DNA, 171 bp, Pinus radiata
acatcccgtcttcactttgttgatcaacaattacgacaacagcgagctcttcagcagctaggaatgatacagcagcatgcctggagaccacaaagagggcttccagagagggccgtttctattctccgggcttggctatttgagcatttccttcatccgtaccccaaaaat

SEQ ID NO: 1846 - DNA, 436 bp, Pinus radiata
agattgatcaaacacaaataccgtaaaatcgcagcgaagatccaaaattccaccatggggactgtggcggaagatggcagcaagggttacacggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcatgttgttgggcaacttcctagttgcttggatggagagttcgtgcgcgttggtcccaatccgaaattcgcaccggtagctggctatcactggtttgatggagatggaatgatccatggtctgagaattaaagatggtaaagccacatatgtgtcacgttatgtgaagacatcacgcttga

SEQ ID NO: 1847 - DNA, 303 bp, Pinus radiata
ggaggcgagccattctttgttccccgctcctcggatcctgcggcgccggaagacgatggctacatcctcacattcatgcacaacgaggagacctcgaagtcggagcttcttattttggacgccagatctccgaccctggaacccgtggcaacggtaaagctgccgtccagagtcccatacggattccacggcacattcatcacttctgaagagcttgccaagcaggtgccgtgaagacgcgctgtcttccgcccttcttgctttcttgattaccctacaacacctggttctgtactttcttta

SEQ ID NO: 1848 - DNA, 551 bp, Pinus radiata
gcgatttcgagtgctgtaagcaggcaacgacgcctgttttgctttagagtttaacagaaaagaagaatgtgtggaggtgctatcatctcggactttataataccccctgcgagccgaggccgccgggtgactgccagggatatatggcccgattttgataagttctctgagtttattaatggaggtgctgcggtggagtcctttgatgtcagcgttgatgtcgatgacgacgaggaggattccgacgatgacgagttcctcgattttgaggagagctatcagaacaagaagaagaagcagcaacagccgatatcccccaccaagggtttcgagcttcctttagctcggggtcttgatggaccggcggccaagagcgcggtgagaaagaggaagaatttgttcagagggatcaggcaacgtccatgggggaaatgggctgcagagatcagggatcccagaaaaggcgctagggtttggctgggtacctttaatacggcggaggaagctgctcgggcttatgatgcagctgcacgaaagatcagaggtaagaa

SEQ ID NO: 1849 - DNA, 527 bp, Pinus radiata
gaacagtcgagcctcgttgcaccctcctcagtcaccacaaacagcactgcagcgaaaggacaagggcctgctgatactgagtctcaaccagacctaactgctgccgagaagccttcaatggagcccaagaaaccgccaagaaagaaaggtcagaaacgaaacagggagcccagatttgcattcatgaccaaaagtgatgtggatcatttggaagatggctatagatggcgcaaatatggccaaaaggctgtcaaaaacagccctttccccaggagttactatcgttgcacaaatggaaaatgctcagtgaagaagagagtggagcgttcgtcagaagatccaggaattgtgattacgacatatgaaggacagcattctcatccaagcccggccatattgcgtgggtcagcagaatcccaatcccacttttcagatcaaagattgaattctcccttcactcaaacgccattgatcagattccctccccacccaatgatgatgagtagtactaaccaggtcccagctgc

SEQ ID NO: 1850 - DNA, 226 bp, Pinus radiata
gagagaaggtggaagtacagcaatagaaagtgacttgaaaagtgaaaatcttgaagaaaaagaagcgaaggcaagtgaaaatgaagataagatgctgaaaaaaccagacaaattgttaccttgtcctcgctgtgacagtttagataccaaattctgctattacaataattacaatgtgaaccagcctaggcatttctgtaaaaattgccagagatattggactgct

SEQ ID NO: 1851 - DNA, 236 bp, Pinus radiata
atggccggagaccacgcttgccccgtctgccaagcgacttttactcgcccgcaacatgtcgcacgacacatgcgctcccacaccggcgaccgcccgtacaagtgctccatctgcaccgactcgtttggccgcagcgacctcctgaagcgacatgagaagaagatgcactcaaacgggcagagcgcagcgagcacgcccactgggccagggcagaacaaatttgatagccagtttac

SEQ ID NO: 1852 - DNA, 455 bp, Pinus radiata
ccacaacgaataaatgcaaatgctgttctggatagctgaacccaccaactcatcagcataaatttctccagcagaaatccagcctcccactcgcgcgcataaatttcttcaacggaaatccagccggccgctaaattctctgcactgacaaaagcccacaggctaacagattccgacatggatcgccccattccctggccatctgcatacacagaaatctagactttgaaaatctttctaaattctgtatggagccctgaactgtaggtgcagggttcgattaccgctatggatgaggccgcgcctgccaaggctcctctcccctgtgactactgtggcgaagcgaatgcagttctctactgccgagctgactccgccaagctctgcctgccatgtgaccaccacgtccattctgccaatgccctgtccaagaagcatgtccgatcccagctctg

SEQ ID NO: 1853 - DNA, 324 bp, Pinus radiata
cttgaatgttgttgcatgtgagggatcagaaagattggaaaggccagaaacttacaaacagtggcagggacggactcagcgtgctggatttgtacagcttcctctggatcgtagtattctctctaaatccagggataaggtaaaaaccatttctatcataaggattttggagtggacgaagatggtaattggatgctattgggctggaagggaagaactattcatgctctgtctacgtggagaccttcgacatgatttggcgatggagaatttttctctctgcaaagagtaaggcatgatacatatttgtgattctgccaaggc

SEQ ID NO: 1854 - DNA, 316 bp, Pinus radiata
acgggctctccaacaattaggcatgattcagcagcatgcttggaggccacagagaggacttcccgagcgatctgtttctgtcttacgggcttggctatttgaacattttcttcatccgtatccaaaagatgcagacaaacatatgctcgcgagacagactgggcttaccagaaatcaggtctcaaattggtttataaatgcacgtgtacgcctctggaagcctatggtggaagagatgtatgtggaggaaacaaaggaggcagaagtagaccatggatcaaatgataaaacaggtaaggagagtggcgagaaaaaa

SEQ ID NO: 1855 - DNA, 393 bp, Pinus radiata
cggaaaatcacccccttgcgttgcgcaccatcgccccgacgtaccgaagtagcggacacggttccgtaatattgtacaggcgcgcgcccacccccacagcgacgacagacacacattctttaacgatccatctccttcttgacgaaacctccacccccaacgattgacgatgcccaaggcggacagccagagcggatcccgagattctacggtcggccccgctcaaggtacgctgaagcggaaccaggcgtgccaccaatgtaggaagcggaaactgaaatgcgacgccaaaagaccttgctcgacttgtgtgaggtcacacaaccacgccatcacccacgctggtccagacgctgttttgccgcccttcccagaatgtacctttgacgaagt

SEQ ID NO: 1856 - DNA, 359 bp, Pinus radiata; identical to SEQ ID NO: 563

SEQ ID NO: 1857 - DNA, 459 bp, Pinus radiata
ggaaggcaatgagagtgatctcctcaagggaatgaagaaggcaaggcgtgagagaggatcaacagcaaaggaacggattagtaaaatgcctccctgtgctgctggaaaacggagttctatctacagaggcgtcacaaggcatagatggacaggacgatatgaagctcatctttgggacaaaagtacttggaaccagaaccaaaataaaaagggcaagcaagtgtacctaggtgcctatgatgaggaggaggctgcagccagagcttatgaccttgccgctctgaaatattggggtcctggaactctcattaattttcctgttagtgactatgctagagatattgaagagatgcagagcatttcaagggaagatttcctggcttctctcagacggaaaagtagtgggttttcaaggggaatgtcaaaatacccgtggactggccaagcaatcacaaactg

SEQ ID NO: 1858 - DNA, 368 bp, Pinus radiata
  misc_feature (1)...(368): n = A,T,C or G
aaaaaggcgtcagaatggggtgagtctgtagtaagtacaagcgaaaacagtaatgacttggatcctcctacttattctgaaacctcttcccctgctcaaggatctgatcctcgggttttcccctgtaatttctgtcaaagnaaattctacagttctcaagcattaggaggtcatcaaaatgcccataagcgtgagagaactttggctagaagggcacagagaatggggtcttttgcacaaagatattcaagcatggcatcacttccactccacggttcctcggaaacaagttggacgcccagtcggtttttagggataaaagcacattctttgattcacaaacctttccctgaaggtgataacctgcc

SEQ ID NO: 1859 - DNA, 497 bp, Pinus radiata
ggcaagaccgtctggaagaggatgttacgggaagagagcaaaagcgttaccgtgtctgcgacccggagctttcggagcgaaccgtggtagtaatgggggcagacccgcacgaatccggagtccgtctcgtgcacacgctgatggcctgcgcagaagcggtgcagcgcggtaatttggccatcgcgcgggaaatggtgaaagaagtgagaattctggcttcagcacagggcggggcaatgagcaaggtcgccacatattttgccgaggctcttgcccggcgaatctatgggtttctccctcaggacaccttgcggttcaaccagaacgaccccttgtccgattttctgcaatttcatttctaccaaacctgcccctatctcaaattcgcgcacttcatagccaaccaggccattctggatgccttctccgggcaccaacaggttcatgtcatagatttcaatctgaaacaggggatccaatggccggccttgatacag

SEQ ID NO: 1860 - DNA, 254 bp, Pinus radiata
gagtaggaggcggcggcggaggcaagggaagcccgtacagaggcgtcaggatgagaaaatggggaaaatgggtttctgaagtgagggagccgaacaagcggtctcgcatatggctcggctcctattccactcccgaggccgctgccagggcctatgatactgccgttttctacctcagaggaccctccgcgactctcaatttccccgaggaagcacgtaaggagcagcagagcgacctcaggctttcgcagctc

SEQ ID NO: 1861 - DNA, 515 bp, Pinus radiata
catcttctccttacaaaagtagctcccctcttgactccaggcggtcttcccagtccataacgatacggattacacccacgcaccccatgtcttccacctcatcgtattcttctccctcccctgacacaccatcacagtctgccgctgtgcgcccgacatctacccgagacgattcttccgtcatggaacctccacgtaagcgagccagggctgatcttaacgctgaacagcgaagagaggccagggcccaccgtaatcgaattgccgctcaaaactctcgcgataaacgcaaggcgcaattcacttacatggagcagcgcgtggcacaactggaggaagagaaccaacgactacgagcaggcatgggcctctctcaattcacgccagccgacaacgacaagttcgtcagcctcgagagagaatcagtacaggcccgcgagaacagagagctcaaggagaggatcaagagtctagagagcgggtggtcggccgtcatcaaagcgttgcaggcctca

SEQ ID NO: 1862 - DNA, 532 bp, Pinus radiata
agtttgctgctctacacctgtggttgcaagcgtttggagcttcaagaggcaaggtttggtctgtgattaattcatggcggcggcggcgacgactacgttgggttgtgcgaaggtggatttgatacggctcatgcggctgcgagagcttacgacagggcagctatcaagtttcgaggagttgaagctgatataaattttactctcaccgactatcaagaagatttagaccagacgagcaagctctctaaagaagagtttgtgcatattctccgtcgtcaaagtactggtttctctcgtggaagttccaagtatagaggcgttaccctgcacaagtgtgggcgatgggaagccagaatgggtcaattcctaggaaaaaagtatatatatttgggattatttgacagtgaagaggaggctgcaagggcatatgataaggctgctatcaggtgcaatggaaaggaggcagtaacgaactttgatcctagcttatatgaaaaagaaattcttgaagaaagaagagagagtcagactt

SEQ ID NO: 1863 - DNA, 497 bp, Pinus radiata
  misc_feature (1)...(497): n = A,T,C or G
ggcacgagcncttctgattttttggccgagggttcgttgcagaaaggccaagggcaagtaggaggcgatagacctacttgaaaatggaggtgtctgcgaagaagcgaaaggccgaagaagcgaatggcgtggtcgatatagccgtggaagatgctcggaaaatgttggaacccttcacccgagagcaactattagatattctgcaggaggcggcgacgcagcacctggacgtattggagcaggtgcgcgccatcgcggacaaggatcctgcgcagagaaagctgttcgtccgtggccttggctgggatacaaatacagagtctctcaaggccctcttttcccagttcggggaactggaggaaggggtcgtcattatggacaagaacaccggtaagagtaagggttacggattcgttactttcaagcacatggacggtgctcttaatgccctaaaggagcccagcaagaagatcgacggccgcatgactgtcagtcag

SEQ ID NO: 1864 - DNA, 308 bp, Pinus radiata
tgcttagatggagtttacgtccgaaatggagcgaatccccggttcaaaccccgaggaggccaccatttatttgacggcgatggaatgatacatgccgtgacgctgcgacacgggaaggctagttacagttgccggttcacggagcccgaaaaggctcattagcgaggaacgggcggggcggcagttttacccgaagcccatcgggcaactccacggccacggacgggctggtgcgcctgctgctgcatggtgcccgggggctctgcgggactggtcaacaccgggaagggcatgggcgtggctaatac

SEQ ID NO: 1865 - DNA, 395 bp, Pinus radiata
aagcggtggcagattgttcacaatgatttcaagtggcgctctttcttctgcagcagagattttgaaggcatatcagctgctcttggttgctactcctttcaagaaaatatctcattttatgacttatcaaacggttcttaatgtagcagagggagaaacgaggttgcacattgttgatttcggaattctgtatggtttccaatggccttctctgattcaatgtctggcaaatcgtcctggtggtcctcccatgcttcgcataactggaatcgagtttccccaacctggatttagaccagcagagagaattgaagagactgggcgcagactggaagactatgcaaaatctttcggtgtgccctttgaataccaggctattgcaacaaagtgggaga

SEQ ID NO: 1866 - DNA, 340 bp, Pinus radiata
gttaacttgaaaattgaacacttctcacccagcagttctgatatggaaaaactggagatcgaagagttggggagtccccagggtgatgtaaaatctttgcttattgaatgtgctaaagctattgcagacggtcgtaatgcagataatttgattgcagggctgagacaagttgtaaatatatatggggatccattgcataggttagctgcatatatggtagaaggtcttgtagcaaggttgcatttctcaggaggacatatttacaaaaccctaaaatgcaaggagcctaccagttccgaactcctttcttacatgcatattctatatgaagtttgtccct

SEQ ID NO: 1867 - DNA, 398 bp, Pinus radiata
  misc_feature (1)...(398): n = A,T,C or G
cttttcaagaagtggaaaagggtgcaaagtggaaccctttccagaagctggcggccgcagttcttgatgcggcggaggacaccctggttcgtccgcttgagaagcaacgcccgttgcccaacacatccgacccaacggttcaactgtgcggcaacttcgcgccggtgccggaaacgcnagtnaagcatgacctggaggtcgagggccgggtaccggagtgcttagatggagtttacgtccgcaatggcgcnaatccccggttcaaaccccgcggcggccaccatttatttnacggcgatggaatgatacatgccgtgacgctgagacacgggaaggctagttacagttgccggttcacggagaccgaaaggctcgttagcgaggagcgggcggggcgg

SEQ ID NO: 1868 - DNA, 200 bp, Pinus radiata
aattgcaaatcttgacagttcaatcggtaaatcaatgaaaagcatctcagatttatcacccatgtgctaattctatgagtggtttttgtttggtgtaggagcgcactgcattctacttcggaaaaaaatatggatgcagagcactttcctgtaggtttctttaggtgggataagagaccagcaccagttgtagcggcagc

SEQ ID NO: 1869 - DNA, 286 bp, Pinus radiata
ggatagtgcagagcggctgaacgtggagaagcacttcttcgcagagaaaataatggggattgtagcttttgagggagccgaaagaaaaatcagactggaaggaagagatcagtggcgtattgtgatggaatcagcgggattcaaatttaccaatttaagtcattatgcaaggagccaagctcgaattcttctctataattattgtgaagcgtattctctagatgaatcgtcggggtttctctctttggcatggcaaaatcggcccctcctcaccgtcctcagcctg

SEQ ID NO: 1870 - DNA, 301 bp, Pinus radiata
  misc_feature (1)...(301): n = A,T,C or G
ctatacctccgcctcttgtcaatttcaggctctttcttcctgatttttcagacagtgtacagtcgcgatattcacacaaggccgccattatcatctatctttcaagaagcagtagaccaaacaagcaaaagcggaaaaactatgggaaagaagaagaggnaggcccccaaggtctggtgttattactgtgagcgcgagttcgntgatgaaaagatattggttcagcaccngaaggccaaacatttcaagtgccatgtctgccacaagaagttgtctacccgctggaggcatggccatccat

SEQ ID NO: 1871 - DNA, 301 bp, Pinus radiata; identical to SEQ ID NO: 461

SEQ ID NO: 1872 - DNA, 447 bp, Pinus radiata; identical to SEQ ID NO: 570

SEQ ID NO: 1873 - DNA, 311 bp, Pinus radiata
gaagatggcagcaagggttacaaggccgtaaatccccatcccaaaaagggcgtcgcctcgtggctggtggacatggtggagaaactggtggttgaaacttctgcgttgtatagttcgaagaagcctctgcattttcttttggggaacttcgctccagtctcggaaactgcccccaaatcgcacctgcctgttgttgggcaacttcctagttgcttggatggagagttcgtgcgcgttggtcccaatccgaaattcgcaccggtagctggctatcactggtttgatggagatggaatgatccatggtctcag

SEQ ID NO: 1874 - DNA, 383 bp, Pinus radiata; identical to SEQ ID NO: 401

SEQ ID NO: 1875 - DNA, 235 bp, Pinus radiata
agagattcaggggtgtgaggaggagatcgtgggggaaatgggtagcggagatcaggatgctccgatgccgatcccgcgtatggttgggatcctaccacactgcagaacaggcagctcgtgcctatgatgctgcctctttctgcctacgaggtcctgctgctttcctcaacttccctgaatctccacctgctcagtttctcccatatcccctgcgccctcttcatgatattcatct

SEQ ID NO: 1876 - DNA, 416 bp, Pinus radiata
gattgtatgagatatcagaaaataaaactgattttaattctgcaggcatctcagaaaaacaaaactggctttacttctacaggcatctcagaaaataaaactggttttacttctgcacagatgtcagaataacaaaactcgttttacttttgcagacatctcagacaataaaactggttggttttagtacttgcccagacatctgagaaaaacaaaaccggttttacttctgccgccggtaaggttttacaagcttgaattcaaactttataatcgggcgctgtttatatgtccaacggaaaatgtgaggtcctacacacgctgacgcgcgagctcgtcgccagttataaacgtaccatggaagccgtagggcacccgggagggcagtttgacggaggccacgacgtcgaggcccg

SEQ ID NO: 1877 - DNA, 320 bp, Pinus radiata
  misc_feature (1)...(320): n = A,T,C or G
gcacaatgttgaagggtgggatagagggtctnatgttgatcacaaagagtttctcagagggattggagggtggagaatgagtatgccaaagctctgtgatgtttgtcaggtatcaagctctgtaatatattgcagagctcatactgcacagctttgcttagtctgtgatgctaaaattcatggtggtagcaaggcttcgttgtgtcatgaaagagtttgggtttgtgaagnatgtgagcaggccccagctgtggttacatgcaaggcagatgcagcagctttatgtgtagcctgtgatactgatattcattctgccaatc

SEQ ID NO: 1878 - DNA, 456 bp, Pinus radiata
ctttggatttcatgggctcatttcactgactccgccgtgaaatatcactaatttcgcttcagagtttctgcaatattgccaaatatggagaattttcccgagcaggaacctgataatgccattgctctaccacacgaagatcgcggttcccgccaatttaagggaatccgactgcgaaaatgggggagctgggcatctgaaatccggataccgagatccagaaagaagatatggcttggctcatacactaccccggagcaggctgcccgcgcttacgacgccgcagtgtattgtctgagagggcgcaatgccgaattcaacttttctgtccctgacattccgactccgtcccccctttcccgtgagcaaattcagcatgccgccgccgaatatgcgttgagccaggccccttcgagtttggcctctttcataggttccccctcgcagtcgtcttcg

SEQ ID NO: 1879 - DNA, 491 bp, Pinus radiata
ccggagtgcttagatggagtttacgtccgcaatggcgcgaatccccggttcaaaccccgcggcggccaccatttatttgacggcgatggaatgatacatgccgtgacgctgagacacgggaaggctagttacagttgccggttcacggagaccgaaaggctcgttagcgaggagcgggcggggcggagcttttacccgaagcccatcgggcaactccacggccacggcgggctggtgcgcctgctgctgcatggtgcccgggggctctgcgggctggtcaacaccgggaagggcatgggcgtggctaatgccgggctggccttctttaacggccgtctgctcgctatgtccgaagacgatctcccgtatgccgtcagggtgacgggtgacggcgatctggtgacgacgggcaggttcgatttcgacgggcagcttcacgggtcgtcatcggtcaccgcgcaccccagcattgaccccgacacgggcgagct

SEQ ID NO: 1880 - DNA, 310 bp, Pinus radiata; identical to SEQ ID NO: 554

SEQ ID NO: 1881 - DNA, 251 bp, Pinus radiata
  misc_feature (1)...(251): n = A,T,C or G
ctggntcctccgatctcgctccctgtaacacgccccggtcagaaatggtgaaggaggaggattgtaaggtgccccaagaggccggaatcgtgaaggaatttcaagcctggactatgcccaagccctgcaacgtgtgcaggatcgcgagcgcttcgctctattgcagggccgacgctgcttatctctgctccggctgcgacgtcaaagttcacggcgccaacaagctggcgtcgcgccacgagagggtgtgg

SEQ ID NO: 1882 - DNA, 351 bp, Pinus radiata; identical to SEQ ID NO: 510

SEQ ID NO: 1883 - DNA, 450 bp, Pinus radiata
tcccttatcacagaatagaaactgatggctagtcagattccagaatgaaccctctaaattaaatgtagcccgcctagaacattagaagaagcaaaagcaaacattcatgatcaataaatgtagattaaaaccaccggcattgatgtgtagtagaagttgaatatggtcaggcatacttgttcctgttgctgtggctggtttcaagttcgtagagctttcctcggccagaaaaaacgatgagcgccacctctgcatcgcacagcactgaaagctcgaaggctttcttcatcagaccgcctcggcgcttccagaaggtcacctgcctgcgcacgctattctcgatcttcttggtttctattttaccgcgccccattttcagcaaaatcccaaaatctgagtatgggcaggcgttgaacttaaatttgctctatgaacagaattaccgagctt

SEQ ID NO: 1884 - DNA, 386 bp, Pinus radiata
aaatgatcagaggcggttctccagttattcacaacaaagaaaaggtcccgcgcttcgggcttctgcccaaatatgcttctgacgagagtgagctgaaatggatcgaggtcccggattgcttctgctttcatctctggaacgcctgggaagaaggagaagacgaggttgtcgtcatcggctcctgtatgaccccgccggacgccattttcaacgaatctgacagcgcgctgcggagtgttctgtcggaaattcggctcaatctcaaaaccggcttgtccaccagacgcgagatcacgccgatgaatctcgagagtacttctagagcggccgcgggcccatcgattttccacccgggtggggtaccaggtaagtgtacccaattcgcc

SEQ ID NO: 1885 - DNA, 190 bp, Pinus radiata
aaatgatcagaggcggttctccagttattcacaacaaagaaaaggtcccgcgcttcgggcttctgcccaaatatgcttctgacgagagtgagctgaaatggatcgaggtcccggattgcttctgctttcatctctggaacgcctgggaagaaggagaagacgaggttgtcgtcatcggctcctgtatgac

SEQ ID NO: 1886 - DNA, 412 bp, Pinus radiata
  misc_feature (1)...(412): n = A,T,C or G
ggtcccagccgccttcnggggcgttcgtgccgcaagatatgcttctgacgagagtgagctgaaatggntcgaggtcccggattgcntctgcnttcatctctggaacgcctgggaagaaggagaagacgaggttgtcgtcatcggctcctgtatgaccccgccggacgccattttcaacgaatctgacagcgcgctgcggagtgttctgtcggaaattcggctcaatctcaaaaccggcttgtccaccagacgcgagatcacgccgatgaatctcgagagtacttctagagcggccgcgggcccatcgattttccacccgggtggggtaccaggtaagtgtacccaattcgccctatacgtgagtcgtattacaattcacctggccgtcgttttacaaccgncntgactggga

SEQ ID NO: 1887 - DNA, 329 bp, Pinus radiata
atcagaaggcggttctccagttattcacaacaaagaaaaggtcccgcgcttcgggcttctgcccaaatatgcttctgacgagagtgagctgaaatggatcgaggtcccggattgcttctgctttcatctctggaacgcctgggaagaaggagaagacgaggttgtcgtcatcggctcctgtatgaccccgccggacgccattttcaacgaatctgacagcgcgctgcggagtgttctgtcggaaattcggctcaatctcaaaaccggcttgtccaccagacgcgagatcacgccgatgaatctcgagagtacttctagaagcggccggc

SEQ ID NO: 1888 - DNA, 101 bp, Pinus radiata
aaatgatcagaggcggttctccagttattcacaacaaagaaaaggtcccgcgcttcgggcttctgcccaaatatgcttctgacgagagtgagctgaaatgg

SEQ ID NO: 1889 - DNA, 326 bp, Pinus radiata
  misc_feature (1)...(326): n = A,T,C or G
atgatcagaggcggttctccagttattcacaacaaagaaaaggtcccgcgcttcgggcttctgcccaaatatgcttctnacgagagtgagctgaaatggatcgaggtcccggattgcttctgctttcatctctggaacgcctgggaagaaggagaagacgaggttgtcgtcatcggctcctgtatgaccccgctggacgccattttcaacgaatctgacagcgcgctgcggagtgttctgtcggaaattcggctcaatctcaaaaccggcttgtccaccagacgcgagatcacgccgatgaatctcgagagtacttctagagcggt

SEQ ID NO: 1890 - DNA, 246 bp, Pinus radiata
agctgaaatggatcgacgtcccggattgcttctgctttcatctctggaacgcctgggaagaaggagaagacgaggttgtcgtcatcggctcctgtatgaccccgccggacgccattttcaacgaatctgacagcgcgctgcggagtgttctgtcggaaattcggctcaatctcaaaaccggcttgtccaccagacgcgagatcacgccgatgaatctcgagagtacttctagagcggccgcggggc

SEQ ID NO: 1891 - DNA, 238 bp, Pinus radiata
aaatgatcagaggcggttctccagttattcacaacaaagaaaaggtcccgcgcttcgggcttctgcccaaatatgcttctgacgagagtgagctgaaatggatcgaggtcccggattgcttctgctttcatctctggaacgcctgggaagaaggagaagacgaggttgtcgtcatcggctcctgtatgaccccgccggacgccattttcaacgaatctgacagcgcgctgcggagtgt

SEQ ID NO: 1892 - DNA, 349 bp, Pinus radiata; identical to SEQ ID NO: 586

SEQ ID NO: 1893 - DNA, 417 bp, Pinus radiata
gaagaagaagaagaagaaagccccgtggtttcagggcgaatgagccgtagcgcctcagaatgggccttccagaagtttctcagttttgatggttccaagattccgtcagaagatggagaaggcgaacagaagcctctcggtgttaaagatcctctgcttcacggtcatatggacaacgtccctgcggcgctcagtcctctctttgccgaagtcaaggatgaggttcttcttcctactgaccctcgagattacgaggccttcctcaagcggaggcttaaccttgcctgcgcggcagtcgccttcactcgggttacaggaattagctctccaggccctggtccctcaacagtggatgcaaaccaatctcagaacactttaggatcagaaagagtgcatcgttggtatcccaatcttccg

SEQ ID NO: 1894 - DNA, 456 bp, Pinus radiata
ggaaggcaatgagagtgatctcctcaagggaatgaagaaggcaaggcgtgagagaggatcaacagcaaaggaacggattagtaaaatgcctccctgtgctgctggaaaacggagttctatctacagaggcgtcacaaggcatagatggacaggacgatatgaagctcatctttgggacaaaagtacttggaaccagaaccaaaataaaaagggcaagcaagtgtacctaggtgcctatgatgaggaggaggctgcagccagagcttatgaccttgccgctctgaaatattggggtcctggaactctcattaattttcctgttagtgactatgctagagatattgaagagatgcagagcatttcaagggaagatttcctggcttctctcagacggaaaagtagtgggttttcaaggggaatgtcaaaataccgtggactgccaagcaatcacaaact

SEQ ID NO: 1895 - DNA, 456 bp, Eucalyptus grandis; identical to SEQ ID NO: 1894

SEQ ID NO: 1896 - DNA, 388 bp, Eucalyptus grandis
gtaaatcaatacctggtcagcatcctaatttagcattcaatgttggcagtattagatccaaccagcagcagcttcagcaacagcatgatctgcccctcctccccaagccagcaacaatgccttttgcctcttcagtaagtatagcaaataattcccagatgcctggtttagggtcaagaggggtaatcaggatgacagatgcatccatcaaaagttccttagctcaaggtggtgggctgcagactggagttggcatgactgggttagacactaggggagttgctcttcagacagtatctcctgctaaccatatatctccggatgtaatctctaggaacacgatggattcgtcttcactctcaccagttccttatccgtttggccgggg

SEQ ID NO: 1897 - DNA, 202 bp, Eucalyptus grandis; identical to SEQ ID NO: 1251

SEQ ID NO: 1898 - DNA, 289 bp, Eucalyptus grandis
gttgaatggggattcaaacaatggcttcacaaggcggcggcggcagcagcggtaatgccagaggtggcggtggcaataatggaaaatccactgaagttcagccattgactcggcagaattcaatatacagtctcactcttgatgaggttcaaaaccagttaggtgatttagggaagccattgagcagcatgaacctggacgagcttttgaagaatgtctggacagctgaggccggtcagtcaatgtttatggatgttgagggcacggctgtggctaatcaaaatgctct

SEQ ID NO: 1899 - DNA, 477 bp, Eucalyptus grandis
cttgaaatcgggcgtgcccagctcgatcgcagcttcaagcagctcaaaaagactgtatatcactcgacgagtgtgctgagcacattgagctcgagctggtcatcaaagccgccattggcagtgaagtaccagctcaaccccggctcactcactgaatcagatgattcaaagagcctctgctccactctggacaagctcttggcttgggagaagaagctctatgaggaagtgaaggctagagaaggtgagaagatagagcatgaaaagaagttgtcagtacttcagagccaggaaggcaagggagaagatgaaaccaaggtagacaagaccaaggcctcattaaataagttgcaagcactaatagctgttacgtcggaggctgtctctacaacttcaaatgcaattattggcctcagagacagtagacttgtcccgcagcttgttgaactctgccatgggttcatgtacatgtggagg

SEQ ID NO: 1900 - DNA, 1243 bp, Eucalyptus grandis
cccccctcttcctcagtcagccagtctctctctctctctctctcacatctctagtttcagcctttttcctccatttggccaagcagcgcccgccgcgcgacccgaaggcttccggatctggtgctcgttgctattccgtccgtcgataggaggctaggctacgctgaaagaagttgatgagcgcaatttcactgatggagtggaatgcgaaacctcctctgcagtgggaatgggagaatcttatgatgttcggttcaaaagcgactgaaacctctaagccgctgcgagcgactgattggggaatcgaggcggaggagctgattgaccccgggtccttatttctgtatgagaatggtggcggcagcagcagttgtaccagcattgatccgggttacacttctgtgtccaagagctcgaaatcggcttctgtcaattcttcgtctacggacgaattgaaaatctcgaaattctctgtggaggcgcatgaaggcttttctctgcagagtagcaagaaagaattggcggtgaatgattttaccggaatgtcaccggcactcgagccttcggtctgctctggtgagccactgctcagtctaaagctcggtaaaaggatatattttgaaaatactattgacaaggatcatgtgaagacccaagaccttccttcggtcatgaaatcacctgatactccagcaaagagaaacaaatccaactgtcagggtacgtccgccccacgctgccaagttgaaggctgtaaccttgacctctcttcagctaaagattaccaccgcaagcatagagtttgtgagagtcactctaaatgccctaaggtcatcgtcagtggtatagagcgtcggttttgtcagcaatgcagcaggtttcatgggctatctgagtttgatgaaaagaagcgtagctgtcgcaagcgcctatctgatcacaatgcaagacgtcgcaagcccccgccagatgtgacccagttgaatccggctagactgtctgcactgttttatggtgggatgcagcagttgaatccagtcttgagcagagctccagctatccacaccaggtctactgctagttttaaatgggcagatacacaggacactaagctcatagagaaaggtccgaagcttccaataggcggaggtgttggtgagtgtatcactatcccaagcaatgggataccggacaccctcaagtccactggattgggcaaaagctataacgaacttctatcatc

SEQ ID NO: 1901 - DNA, 366 bp, Eucalyptus grandis
aaaaagtatatatacctcggcctatttgatagtgaagtagaggcagcaagggcgtatgacaaggcagctatcaaatgtaatggaagagaggctgtgaccaactttgaacctagtacgtacgatggagagatgattgcaaaagccagcaatgaaaatagcatctatggtgaccatggtcttgatctcaatctcgggatatcagcttcttccaggggaatggtggaaaccttagagccctcggacgacatgcgtcagggaagtagtttaagggtaggaaactctgctgcatcctggggtgatccatctgttgaaggtttatcgatgacatctggacaacctctccttgacgggtgtttatcctaccgt

SEQ ID NO: 1902 - DNA, 466 bp, Pinus radiata
ttaattcatggcggcggcggcgacgactacgttgggttgtgcgaaggtggatttgatacggctcatgcggctgcgagagcttacgacagggcagctatcaagtttcgaggagttgaagctgatataaattttactctcaccgactatcaagaagatttagaccagacgagcaagctctctaaagaagagtttgtgcatattctccgtcgtcaaagtactggtttctctcgtggaagttccaagtatagaggcgttaccctgcacaagtgtgggcgatgggaagccagaatgggtcaattcctaggaaaaaagtatatatatttgggattatttgacagtgaagaggaggctgcaagggcatatgataaggctgctatcaggtgcaatggaaaggaggcagtaacgaactttgatcctagcttatatgaaaaagaaattcttgaagaaagaagagagagtcagactt

SEQ ID NO: 1903 - DNA, 240 bp, Pinus radiata
gcttattggaatgcctgacactaactatggaagcgaacagacaaatgcttgcaaaaaacagaaaagaatacgttccaaggattcaggagaagatggtgaagatagacagagagaacatcctttcattgttactgagcccggtgaacttgcaagagggaaaaagaatgggttagactatctctttgatctttatgaacagtgcgggaaatttctgctggatgtgcaacatattgcgaagga

SEQ ID NO: 1904 - DNA, 495 bp, Pinus radiata
gccatggcaatagattttgcaggacgggaatctcctcgtgtgcaggctcgcagataccccattgccaggccgagggttgtaaggcaaacttgagcagtgccaaacactaccatcgccggcataaggtttgtgaattgcactcgaaggcttctactgttattgtgggtggtttcattcagcggttctgccaacaatgtagcagatttcatccaagatctgaattcgacgagggaaaacgaagctgcagaaagcgccttgctgaccacaacagacgaaggagaaaacctcagccaagtacatgtgttacatcacaatctcaggctgggacaacaggtttagaaaatgataaccagacaactaaaggatcatcaggtcacattacaacggctgttcagaatacaccgaacattagcagaagcactagtagtactagtccgtccttgattacatcagtaccgatgatgatgttcccaaataactataaaggacatagtc

SEQ ID NO: 1905 - DNA, 377 bp, Eucalyptus grandis
taacactacattcatcaccccaaacagcaaacggatcatctcgcacaatccatcaagtgtagatcgaccggcggaatctgcagcactggcaaagaggatgaggagggctcacattcagaatatagcgggagattgcaacttgaaagacagattacatatacaaagtggaatcacatatagtcagcaacaaagagctcccttttccacattggcgcagaacttccgcactagcaattcgcccccccagcaatctgaaagcaaccaaaaagaagccaccgatgatgctcatggcaccaacgtccaaggaacatttcttaaaaaggatgatccaaaagttactgctctgattcaacaagccgagctgctcagttcccttg

SEQ ID NO: 1906 - DNA, 377 bp, Eucalyptus grandis
gtgattttagtgctcgatactttgaaaagggcatcaatacagtcaaacgagataaaaagacataacatgcaaaactcaatacatgattctcagaaaagaccatcatctttaattcagtcaaacgaggctgtttttacgcaaacttcggtcataagctgtgccttgcaatcgtttgttaaacctccaaatgctaaggtcacggtcacattcctctctgatctttgagcagctcatggcaccaacgtccaaggaacatttcttaaaaaggatgatccaaaagttactgctctgattcaacaagccgagctgctcagttcccttgcggtgaaagtcaatgcagataacatggaccagagtcttgaaaatgcttggaaggg

SEQ ID NO: 1907 - DNA, 1668 bp, Pinus radiata
agctgtaagctacctacgaagtggaatcgaagagagagagagtgagaggctaactaataagatgaatatgaagattcgaacctccgacaccagtactcctgatgatcagcaacagcatagcggcgccgtgaaagtggcgattccggccgtgtcgggggattcggggacgattgggttaaagctgggcaagcggacctattttgaggcggtgaaggcaattccgacagcgatcccctcgccgtcttgcgttccggctgccaagaagcagcagtctgcgttgcagggaacgcatatggtgccgcggtgtcaggtggagggatgcgagatggaactcaccgccgcaaaggactaccaccgccgccacaaggtctgcgagctccactccaagtttcccaaggtcatcgtcaacgggatcgagcagcgcttctgtcagcaatgtagcaggtttcatacgttgtctgagtttgatgaagggaagcggagctgtcggaggcgtctagctggccacaaccagcggcgtaggaaaccccaacttaattcaacggcgatgaaagctgcaagatttgcttccactttctatgatgacgggcgacttagcagcatcctgatggctagatcacctttcatgcatccacggatagcttcaaacttggaggagaattcgctcgatttcaaacttggaggatatggaaaaggagcttggccgaggattaaggctgaggatgtatcatcatatgatgggcaattatcaaccaaataccctctcccgtcataatgctgaaagattgcttttccttttacagggttctaagactgtacctggtggagctattaatcaaagcactcatcagtacaggcaaagctccagggatcatgtgggccaatccttgaccttgtcatcctgctcgggagaaaatctaacaggtttaaatgttatatctgccccacatggtttatcaggagtctcggactctggctgtgcgcactagcttctgtcaattcaatccgggggcccaaggtcctcaggatcagcttcatttgatatgaccacgcggtcaggtctcacaatggatcaacttatactagaggatcaacctcttatggctcaagcaccattgatgcaaggagtacaacacaactttggtcattttgcagaagacaagttactaacaatgtatccccagtcctctactaatcttgcaacaggtgggttccctgcagctactgtgaattctatggataagcagcaccaaggtcatccactcgtttccgatgcaggccaaatggtaaactttggaggaaatatatttggcttgctgcaggggagcagtttcagaggctctcaagctgcaagttcacaagatattcaaggcaccatagatctgatgtgcacgtcctcggaaacacaaactaatgattctcatgatcaacttggcatggtgcaccagggaagtaaacagtttactgacttgcagttgttgaggtcttttgaatcatctatttatgacactcatcaactgctgtagctctaatctggttgttcttccggcatgttttctttgccctcagacttgaagataactgttaaaacttcattatgacaattatctgtaccctctaaatgcagacaattgctttcaattacccttgcttatttcaaaaaaaaaa

SEQ ID NO: 1908 - DNA, 821 bp, Eucalyptus grandis
ctctctctctctctctctctctctttctttctttctttctctctctagcagaggcacagaggcgcgcagagggcactgatgatgacgactggggtagctccaatgaatgggctctagagaacctcgctcatggacgtgggttcgggctcgtggacgacggagtccgggtcctcttctcctccccctctcgagtccctcaacggcctcaagttcggccagaaaatctacttccagaataataacagtagtaataatgccgccgcacccaagaacggctccggctccggctccggctcctcctccgccgccgcgcccgcgcccgggtcgggcacgcccccgaagaaggtgagggcctccgccggcggcggcggctgcggggcgatccagggcgggcagcccccgaggtgccaggtggaaggctgccgggtggatctgagcgatgccaaggcttactattccaggcacaaggtgtgcggcatgcactccaagtccgccaccgtcatcgtcgccggcatcgagcagaggttctgccagcagtgcagcagattccatcagcttactgaatttgaccaagggaaacgaagctgtcgtagacgtttggctggtcacaatgagcgccggaggaagcccccacctgggtcgctactatcctctcgctatgggcgactgcaatcctctatatttgagaacaccaccagagtgggtagttttctgatggatttcacagcatacccgaagcatgcatggtcagcgccacgtttttctgagcgcacgacacctggagatctagtccccggaccaggaaaggtctatcctcatcc

SEQ ID NO: 1909 - DNA, 105 bp, Eucalyptus grandis
gggaagaggagcgtagagtgggattcgaacgattggaagtgggacggtgatctgttcgtcgctaggccgctgaacccggtcccgtccgatttccccggccggcag

SEQ ID NO: 1910 - DNA, 338 bp, Pinus radiata
cagaagagacctgccatggaaacacattttgcaggacagaaatttcatcattcacaggctcacagataccccagtgccagtccgagggttgtaaagcaaacttgagcagtgccaaacactaccatcgccgacataaagtttgcgaattccactctaaggctcctacggtcgttgttggcggtcagattcagcggttttgccaacagtgtagtagatttcatcagacatctgaatttgacggaggaaagcggagctgcagaaagcgccttgctgaccacaacagacgccggcggaaacctaaaccgagtcaatgtactacatcccaatgtcaggcaggg

SEQ ID NO: 1911 - DNA, 465 bp, Pinus radiata
tcgacatggtcctttgcattttcttgaagaagctgtgattgttcgaccgacacgttactcattcacattgcctctccatctccttcaatcaggattccagaattgcccgtcgaaatggatgaagtccaagtcaaggtcgacattcagagcacaaatgtcagtgccgacgagcccaggcctgcgaagcgccagggtttcgagctcgccaagagccctgaaaacgtggcttcgaaatccactgcgctctcctctccgaaaaaacccaaagctgcttcttcctcttcttcttcgtcgccgagagcgcagcctcccgcttgccaggtggagaaatgcgcggcggatcttgctgatgccaaagagtactataggaggcacagggtttgcgagcaacattcaaaggctcgaattgtgctcgttcttggcctccagcaacgcttctgccagcaatgtagcagattccatgtg

SEQ ID NO: 1912 - DNA, 509 bp, Pinus radiata
ctccttacaaaagtagctcccctcttgactccaggcggtcttcccagtccataacgatacggattacacccacgcaccccatgtcttccacctcatcgtattcttctccctcccctgacacaccatcacagtctgccgctgtgcgcccgacatctacccgagacgattcttccgtcatggaacctccacgtaagcgagccagggctgatcttaacgctgaacagcgaagagaggccagggcccaccgtaatcgaattgccgctcaaaactctcgcgataaacgcaaggcgcaattcacttacatggagcagcgcgtggcacaactggaggaagagaaccaacgactacgagcaggcatgggcctctctcaattcacgccagccgacaacgacaagttcgtcagcctcgagagagaatcagtacaggcccgcgagaacagagagctcaaggagaggatcaagagtctagagagcgggtggtcggccgtcatcaaagcgttgcaggcctca

SEQ ID NO: 1913 - protein, 151 aa, Pinus radiata
EGNESDLLKGMKKARRERGSTAKERISKMPPCAAGKRSSIYRGVTRHRWTGRYEAHLWDKSTWNQNQNKKGKQVYLGAYDEEEAAARAYDLAALKYWGPGTLINFPVSDYARDIEEMQSISREDFLASLRRKSSGFSRGMSKYRGLPSNHK

SEQ ID NO: 1914 - protein, 128 aa, Eucalyptus grandis
KSIPGQHPNLAFNVGSIRSNQQQLQQQHDLPLLPKPATMPFASSVSIANNSQMPGLGSRGVIRMTDASIKSSLAQGGGLQTGVGMTGLDTRGVALQTVSPANHISPDVISRNTMDSSSLSPVPYPFGR

SEQ ID NO: 1915 - protein, 66 aa, Eucalyptus grandis
AKHAQTPPTSWEGGSGADSEVNMLKDYASEDWITGVDRFRLSLVEFLDKLNKYAESSVHMYVSLEK

SEQ ID NO: 1916 - protein, 89 aa, Eucalyptus grandis
MASQGGGGSSGNARGGGGNNGKSTEVQPLTRQNSIYSLTLDEVQNQLGDLGKPLSSMNLDELLKNVWTAEAGQSMFMDVEGTAVANQNA

SEQ ID NO: 1917 - protein, 159 aa, Eucalyptus grandis
LEIGRAQLDRSFKQLKKTVYHSTSVLSTLSSSWSSKPPLAVKYQLNPGSLTESDDSKSLCSTLDKLLAWEKKLYEEVKAREGEKIEHEKKLSVLQSQEGKGEDETKVDKTKASLNKLQALIAVTSEAVSTTSNAIIGLRDSRLVPQLVELCHGFMYMWR

SEQ ID NO: 1918 - protein, 349 aa, Eucalyptus grandis
MEWNAKPPLQWEWENLMMFGSKATETSKPLRATDWGIEAEELIDPGSLFLYENGGGSSSCTSIDPGYTSVSKSSKSASVNSSSTDELKISKFSVEAHEGFSLQSSKKELAVNDFTGMSPALEPSVCSGEPLLSLKLGKRIYFENTIDKDHVKTQDLPSVMKSPDTPAKRNKSNCQGTSAPRCQVEGCNLDLSSAKDYHRKHRVCESHSKCPKVIVSGIERRFCQQCSRFHGLSEFDEKKRSCRKRLSDHNARRRKPPPDVTQLNPARLSALFYGGMQQLNPVLSRAPAIHTRSTASFKWADTQDTKLIEKGPKLPIGGGVGECITIPSNGIPDTLKSTGLGKSYNELLS

SEQ ID NO: 1919 - protein, 122 aa, Eucalyptus grandis
KKYIYLGLFDSEVEAARAYDKAAIKCNGREAVTNFEPSTYDGEMIAKASNENSIYGDHGLDLNLGISASSRGMVETLEPSDDMRQGSSLRVGNSAASWGDPSVEGLSMTSGQPLLDGCLSYR

SEQ ID NO: 1920 - protein, 155 aa, Pinus radiata
LIHGGGGDDYVGLCEGGFDTAHAAARAYDRAAIKFRGVEADINFTLTDYQEDLDQTSKLSKEEFVHILRRQSTGFSRGSSKYRGVTLHKCGRWEARMGQFLGKKYIYLGLFDSEEEAARAYDKAAIRCNGKEAVTNFDPSLYEKEILEERRESQT

SEQ ID NO: 1921 - protein, 79 aa, Pinus radiata
LIGMPDTNYGSEQTNACKKQKRIRSKDSGEDGEDRQREHPFIVTEPGELARGKKNGLDYLFDLYEQCGKFLLDVQHIAK

SEQ ID NO: 1922 - protein, 164 aa, Pinus radiata
HGNRFCRTGISSCAGSQIPHCQAEGCKANLSSAKHYHRRHKVCELHSKASTVIVGGFIQRFCQQCSRFHPRSEFDEGKRSCRKRLADHNRRRRKPQPSTCVTSQSQAGTTGLENDNQTTKGSSGHITTAVQNTPNISRSTSSTSPSLITSVPMMMFPNNYKGHS

SEQ ID NO: 1923 - protein, 125 aa, Eucalyptus grandis
NTTFITPNSKRIISHNPSSVDRPAESAALAKRMRRAHIQNIAGDCNLKDRLHIQSGITYSQQQRAPFSTLAQNFRTSNSPPQQSESNQKEATDDAHGTNVQGTFLKKDDPKVTALIQQAELLSSL

SEQ ID NO: 1924 - protein, 50 aa, Eucalyptus grandis
AAHGTNVQGTFLKKDDPKVTALIQQAELLSSLAVKVNADNMDQSLENAWK

SEQ ID NO: 1925 - protein, 257 aa, Pinus radiata
AVSYLRSGIEERESERLTNKMNMKIRTSDTSTPDDQQQHSGAVKVAIPAVSGDSGTIGLKLGKRTYFEAVKAIPTAIPSPSCVPAAKKQQSALQGTHMVPRCQVEGCEMELTAAKDYHRRHKVCELHSKFPKVIVNGIEQRFCQQCSRFHTLSEFDEGKRSCRRRLAGHNQRRRKPQLNSTAMKAARFASTFYDDGRLSSILMARSPFMHPRIASNLEENSLDFKLGGYGKGAWPRIKAEDVSSYDGQLSTKYPLPS

SEQ ID NO: 1926 - protein, 230 aa, Eucalyptus grandis
MDVGSGSWTTESGSSSPPPLESLNGLKFGQKIYFQNNNSSNNAAAPKNGSGSGSGSSSAAAPAPGSGTPPKKVRASAGGGGCGAIQGGQPPRCQVEGCRVDLSDAKAYYSRHKVCGMHSKSATVIVAGIEQRFCQQCSRFHQLTEFDQGKRSCRRRLAGHNERRRKPPPGSLLSSRYGRLQSSIFENTTRVGSFLMDFTAYPKHAWSAPRFSERTTPGDLVPGPGKVYPH

SEQ ID NO: 1927 - protein, 35 aa, Eucalyptus grandis
GKRSVEWDSNDWKWDGDLFVARPLNPVPSDFPGRQ

SEQ ID NO: 1928 - protein, 112 aa, Pinus radiata
EETCHGNTFCRTEISSFTGSQIPQCQSEGCKANLSSAKHYHRRHKVCEFHSKAPTVVVGGQIQRFCQQCSRFHQTSEFDGGKRSCRKRLADHNRRRRKPKPSQCTTSQCQAG

SEQ ID NO: 1929 - protein, 117 aa, Pinus radiata
MDEVQVKVDIQSTNVSADEPRPAKRQGFELAKSPENVASKSTALSSPKKPKAASSSSSSSPRAQPPACQVEKCAADLADAKEYYRRHRVCEQHSKARIVLVLGLQQRFCQQCSRFHV

SEQ ID NO: 1930 - protein, 143 aa, Pinus radiata
MSSTSSYSSPSPDTPSQSAAVRPTSTRDDSSVMEPPRKRARADLNAEQRREARAHRNRIAAQNSRDKRKAQFTYMEQRVAQLEEENQRLRAGMGLSQFTPADNDKFVSLERESVQARENRELKERIKSLESGWSAVIKALQAS

SEQ ID NO: 1931 - DNA, 199 bp, Pinus radiata
aacaactgaacaataaaaatcacaagcactgaatctaaccatctctccacaaagcagaatcattttttagcagtgcagaattaaatcaaaacacaattgttcggctgtaaagcaaagatgaagcatcacgtagtgcacaattgctgtagcaagaaagctgtaaagagaggcttctggtcgcccgaggaagatttgaagc

SEQ ID NO: 1932 - DNA, 380 bp, Eucalyptus grandis
gggatctctaggaacttcgtgaaaacgcggacgccgacacaggtggcgagccacgcccagaagtacttcctccggcggaccaaccagaaccggcgacgccggcggtccagcctcttcgacataaccaccgactcgtactttggggtttcaagctctacaatggaggagggtcatcatcaagcgcaccaagtacccagcttccctctttccttgcctccggcggtttcaccgggaaccggcgagaaactgctggaaagtctgcgactaagaaaagagggctgccagtcgaaacccaccccgtcgaagcccatccgcccggtcccgatccttcccatccctccgtcctcgaaaatggcggctctcgacctcaacaaggcgac

SEQ ID NO: 1933 - DNA, 630 bp, Eucalyptus grandis
ggaccggcgagtttctccggggaagaccggcggagcggcggcggcggcggcggcggcggggggaaaagctcccgcctttcgtcgtttcgcggtccgtggaataggcgacaagtcggattgcgttgcgtgtcgcgcctcgcttcgtatataagggcggcttgctgctgctgctactggtctgaggagtcaaccgagctcgagcgttacgcgcttcccgaaggttccgccggctagggtttttttatatttccctctgtttttcctccgttcggccacggtcgttgcttcgctttaaaaggattggcgcgattgagctgggcggagcttgagggttcgggcggtggcggcggaagtggagtggagcggggggtggtggtgctcgacatggtaatcgggttctgacgatgccgagctttgttccagcgacaccggcctccaattccattggttcggagggaaacgttgtccagtctaatcaaaatacagattttgggtcgtttgagcattcacttggattccgcatagaggatgccatcaaccttagcagaacagatcctgtctttaatcagataaaaccaaacggtcgagctcttggaactgacattcaagctcgtgcttttaataagtctg

SEQ ID NO: 1934 - DNA, 524 bp, Eucalyptus grandis
ctttactattctaagtcctctacttctggtttggaatcactaatttcttggtctcactttcgcttggcctatcacccgagagttctctgcagaaacttcacagccgtcctctgctctttcaccaaccattgtatgcctggttttactagggctaggaagatgagcatgtccggagaagaagagggtgacctgcgaagggggccatggactcgcgaggaagacaatttgctcattcactcgatcacatgccacggcgagggacgctggaatatgttggcgaagagcgcaggattgaagagaactggcaaaagctgcagattaaggtggctgaattacctgagacccgacatcaagcgcgggaatctcaccccgcaagaacagctcatgatccttgaacttcaccacaaatggggcaacaggtggtcgaaaatcgcgcagtatctcccaggaaggacagataacgagatcaagaactactggaggacgcgggtgcagaagcaagcgcgccagctcaacatcgaatc

SEQ ID NO: 1935 - DNA, 440 bp, Eucalyptus grandis
gtgctgtgacaaggtgggattgaagaaagggccgtggacacctgaagaagaccagaagctcctcgcttacatcgaagagaacggccatggaagctggcgtgctttgccttccaaagctggtcttcagagatgcgggaaaagctgtaggctaagatggactaattatcttagacctgacatcaagagagggaagttcagcttacaagaggaacagaccataattcaactccatgcccttcttggcaataggtggtcggccatagcaactcatttaccgaagcgaacagacaacgagatcaagaactactggaatacgcatctgaagaagagattggcgaaaatgggaattgacccggtgacccataagcctaaaaatgacgccctagtctctagtgacggtcaatccaagagcgcggctaagctcagtcacctggctcagt

SEQ ID NO: 1936 - DNA, 299 bp, Eucalyptus grandis
cggacccttccgaaaaatgcagggctcaggagatgcggaaagagctgtcgcctgcggtggacgaactacctgcggcccgatatcaagagagggaggttcacgttcgaggaagaggagaccatcatccagttgcatggtgttttggggaacaagtggtcggctatcgcggctcaattgcccgggaggaccgacaacgagatcaagaactactggaacacccacatcaagaaaaggctacttaaaatggggatcgacccggtgacacactccccacgcctcgatcttctagatctgtcctc

SEQ ID NO: 1937 - DNA, 377 bp, Eucalyptus grandis
ggcccctctctctttctctctctctgtgtctgtctttcttgtggatccaccaggctcgtctttaagaatatacagcagcgagcaggcaagacaacgccccatctctcttctctctctctctctctctgtggctctgtctttcttttgtttcttgccgttttggggtgtgtgtgttgggttgtgtgaattggagcgaggatggggagggggagactgcagctgaagaggatagagaacaagatcaaccggcaagtcaccttctccaagaggagggcgggtctgctcaagaaggcccacgagatctccgtactctgcgacgccgaggtcgccctcatcatcttctccgccaagggcaagctcttcgagtactccaccga

SEQ ID NO: 1938 - DNA, 278 bp, Eucalyptus grandis
tgttagcaagcatgtatgtactaactagtagtttttgtaaagcatgatgtcgaaaccttgagtagcaaggtgaagatggctgaagagacggttaaaagagtaaccggactgaacccaatgctgcatgtgatgtccgacatgtcttctgtgggtgtgccaccatttgatggtagtccttctgatacatcagcggatgctgcagttcctgtgcgagatgacccaaagcaccaattctatcaaaccaattctagtaaccccgcatcatctgctgacgatat

SEQ ID NO: 1939 - DNA, 342 bp, Eucalyptus grandis
acaggttgctcaattaagagttgagaattctactttactgaaacgtctctcggacataagccagaagtacaatgtagcagctgttgacaacagagttttggaagctgatgtcgaaaccttgagagcagaggtgaagatggctgaagagacggttaaaagagtaaccggactgaacccaatgctgcatgtgatgtccgacatgtcttctgtgggtgtgccaccatttgatggtagtccttctgatacatcagcggatgctgcagttcctgtgcgagatgacccaaagcaccaattctatcaaaccaattctatgtaaccccgcatcatctgctgacgatatga

SEQ ID NO: 1940 - DNA, 376 bp, Eucalyptus grandis
gctgttttcacatctttttgaacacgcccctaaagatccgccctcagagccgcctctgtccggtggctgctgacattccacctagaaattcccgaccaagttccccctttctaagccagattgggaaaggttcatatttgtccaacagtagtagtggatttaaatggggaggcactcttgctgctacaagcagaagctgaggaaaggcctctggtcacctgaagaagacgagaagctcctcaggtacatcacgcagtatggccatggttgctggagctctgttcctaagcttgcaggtctgcagaggtgtgggaagagctgcagattgaggtggattaactacctgaggcctgatttgaagaggggcacattctct

SEQ ID NO: 1941 - DNA, 169 bp, Eucalyptus grandis
aggaattgcagcacctggaacagcaattgagtggggccttatcatctgtcaaggagaagaaggagcaatggcttctggagcagctggagcgttcaagattacaggagcagagggctatgctggagaatgaaactctgcgcagacaggtcgacgagcttagaggtttcct

SEQ ID NO: 1942 - DNA, 188 bp, Eucalyptus grandis; identical to SEQ ID NO: 27

SEQ ID NO: 1943 - DNA, 321 bp, Eucalyptus grandis
ctctttcctcctcaatcggaagggttcttcaacccaatggacggcaacctctcattgcaaatcggatacaatccgacatgtctggacgagatgaatgcttcggtttcgagccaaaatgttgctggattcattccgggatggatgctttgaacttactacatcgacttggagtgtgaatcgagctggtgaaatttgtgcgtgtgtcccttgtaaaattgcgatccgcaagacaataagtacataatattttggagctgtgatgacataaaaagaggaaggccaccctttcctctctcatgatcagaacttttgataatgtct

SEQ ID NO: 1944 - DNA, 905 bp, Eucalyptus grandis
ctagtggatcccaagtctccatcatcatgatctccagcaccggcaagctccacgagtacatcagcccctccacctcaacgaagaagatgtacgatcagtatcagcaggcgctcgaggttgatctctggagctctcactatgagaagatgcaagagaacctgaggaagctgaaggaggtgaacaagaagcttcagctggaggtcaggaggaggttcggggaaggactgaatggtatgagcttatcggaattgtgcggtcttgagcaagatatggacaacgccgttagcctgatccgtgaacggaagtacaagacgctcggcaatcaaatcgacaccgccaggaagaagaaaaagaatgctgaggaaataaacaaaagtctcctgcaagactggaccaatctgatcaagcatctgagggaggacgacccgcacttcggaatggtcgacaacggcagggattacgaggctgtgatcgggtatacagacgccgccgccgccgctcgcttgtacaccctgcgcctgcaaccggaccagcccaatcttactagcggaggaggatcggagatcacgacctaccctttgctcgagtgagacgaaggcgtcggaaacccttccgacgtcctcatattgtctattcattctgtctaagggccgattccatctggaatcctgacttcattggtatgtcgaagtttaggactttgttatgtcatcctattcagcagctaagtttgttcttatcagaagctgttcctattatggaccgagggcgatttcctctagggcatcatgtgttttaagacaagtctatatataagactactttaaaacaatcgaatgagttggtgcaaaaaaaaaaaaaaaaaaaaaaacaaaaaaaaaaaaaaaaaaaaaaaaaacttcaag

SEQ ID NO: 1945 - DNA, 337 bp, Eucalyptus grandis
gcggcaaggagcaactaaatgtaacactctgattactagggacctctcattgtctttggatggcatttaaatcaccaggaggaatcacgtggctgaaacatttacttgtgaagaacttttacttaggggagcatctaaaatgcaggaatgggctcatcaagaaggcctacgagctctccgtcctctgcgacatcgacatcgccctcatcatgttctccccctccgaccgcgtgagccacttttcgggaaaaagaaggatcgaggatgtcttgacccgtttcattaacctcaccgaccaagaacggacactcctagatgtccaggatcggcgcacacg

SEQ ID NO: 1946 - DNA, 301 bp, Eucalyptus grandis; identical to SEQ ID NO: 26

SEQ ID NO: 1947 - DNA, 354 bp, Eucalyptus grandis; identical to SEQ ID NO: 64

SEQ ID NO: 1948 - DNA, 456 bp, Eucalyptus grandis
gtttcctcttcaggagaaagcaaggagctgtagaggaattgaaaatggtgcaagaagtccgaaagggtccatggacagaacaagaagatttccaactggtgtgctttgttggactttttggagatcgccgatgggattttatagcgaaggtatcaggtttgaaggtggcgggagaaaataataggtatgttcgttttaaagcctgggggttttttggaaggagctacttctaaccgcccagctttattccaggattgaatagaacaggaaaaagctgcagactacgctgggttaactacctgcatcctggcctaaaacgagggaagatgacacctcaagaagagagactggtgctcgaacttcattccaaatggggaaatagatggtcaagaattgctcgcaagctaccagggcgaacggacaatgagataaagaactattggaggactcatatga

SEQ ID NO: 1949 - DNA, 382 bp, Eucalyptus grandis
atttttcaactccccccccccaccccgaatcaaatcccattccctctctccctccctccctttttttcccccaatcttttgttgcgttttcaagcacccacgccccccaatctccaacgccatcaatcaagctcaagcaccatcacctcaagaagaaagaaggaaagaaagagagaaggaccggagacccgacagagggtcgcgcgcgcacgagacatgggacgatccccttgctgcgagaaggcgcacaccaacaagggcgcgtggaccaaggaagaggaccagcgcctcatcgactacatccgcctccacggcgaaggttgctggcgctccctccccaaatctgccgggcttctcaggtgcggcaagagctgcaggctca

SEQ ID NO: 1950 - DNA, 371 bp, Eucalyptus grandis; identical to SEQ ID NO: 66

SEQ ID NO: 1951 - DNA, 356 bp, Eucalyptus grandis
aaaaagcataagctccctgacccataatccctagtatcgatggccaggtttcccagggttgacaagagcaacagcaagaagacagtgaagaagggcgcttggagtgcggaagaagaccagaaactggtggcttatatcaagagatatggcatttggaactggactcacatggccgaacccgccggtttagcgagaacaggaaagagttgccggcttcgatggatgaactatctgaggcccaacatcaagcatggaaacatcacccaagaagaggaagaaatcattattaacttgcaccgagttcttggtaaccgttgggccagcatagcgagcagactttcaggaaggacggacaa

SEQ ID NO: 1952 - DNA, 475 bp, Eucalyptus grandis
ctcccctctcctggctctcgctctctctctctctctcagttctttctcggacgggtgtctgtgcgtggcttttgatcggtcatcacctgaggccgcgtctgcaagcaagtgaagaaggaggacaaggaatatggcgagagagaagatcaagatcaagaagatagacaatgtgacggcgaggcaggtgacgttttctaagaggagacgagggcttttcaagaaagccggagagctgtcggtcctgtgcgatgccgaggtcgctgtcgtcattttctcggctaccggcaagctctttgagtactccagctccagcatgaaggacactcttgagaggtacaccctccaccacaataatcttgagaatatggaccaaccttctctcgagctgcagctggagcatagcaataacatgaggttaagcaaggaagtggcagaaaagagccatcgactcaggcagttgaggggtgaggatctt

SEQ ID NO: 1953 - DNA, 541 bp, Eucalyptus grandis
atcgcccccgttctctccctctctctccctctcccccctaacgtttctggccctcttctttgtctggacaaaaagatgggaagaaagtgctctcgctgtgggaacataggccataactcaaggacttgcacaactttcatgggggcagcaagtgcttgtgggctcaagctcttcggtgttcaacttgacctatcttcttcttctcctccttcatcatcagcatctagtggttctgctcatccttattcacttgtcataaagaagagcctcagcatggatcgtctgtcttcttcctcggcctcctcctcgtctccatcttcatccctctcctcgccaagagttcttgctgatgaacactgcaataagacctccctcggatatctctctgatggcctcgccgctagatcccaggagaaaaggaaaggagttccgtggacggaagaagagcatcggacattcttaatggggctagagaagatggggaaaggcgattggagaggcatctccaggaactatgtgaccacgagaaccccaacccaag

SEQ ID NO: 1954 - DNA, 437 bp, Eucalyptus grandis
cgcggttggcgtcagatagaagagcatgtaggaaccaaaactgcagttcagatacgaagtcatgcccaaaagttcttctctaaggttgctcgcggggtaagtggcagcagcgagggtgtgattaaaccaattgaaatacctcctccacggccaaagcggaagccaatgcatccatatccacgcaaatctgtcgattcaaaggaggtgaaactgtcctatcaacaagagaggtctccatctccaatctcttcggtagcagatgaaaacactggatctcctacttcagttttgtctgctcatggttcagacatgctgggatcagcatctttgcatcaacaaaacagatgctcttcaccgacttcatgtaccactgatgtaccctctattggtctagctgtaattgagaagcaacctgaaatattcaaagaagaagataa

SEQ ID NO: 1955 - DNA, 470 bp, Eucalyptus grandis
attcggtcacgagttcacttcgtcgcctgcctcgtcgtcctccctgtcctcctcgcgaatctccatcggcgagaactctgataaagcatccctcggctatctgtcggatggcctgctgggtagatcccaagagaagaagaaaggagttccatggacagaggaggaacacagaaccttcttggtggggcttgagaagcttgggaagggtgattggagaggcatctctaggagctatgtgaccacaagaacaccggcccaggttgcaagtcatgctcagaaatatttcctccggcaagtgagcttcaacaagaaaaagcggcgctcgagcctctttgacatggttgatgtcaaaaccgcggcgggtgatcgtttaggcagtttgacggccaagccgagtgagtcagttcctaattgcaaaatgggaaccttgatgtctcatttgcaagttcatgatgccagaaccactcagc

SEQ ID NO: 1956 - DNA, 384 bp, Eucalyptus grandis
ctgaaatttcgtcttcaagccatggaacaacaggcgcaactacgcgatgccctgaatgaagcattgactgctgaggtgcaacgattgaagcttgcgacagcagagctcaactcggaatctcatccttcaaagtgcatggtttcacagcttcctgtgagctcccaaatgttccagctccatcagatgcaacagcagcagcagtctcagcaacaaactcaatcacagcagcaaaatggtaacacaaccacaaagtcagagtcgaatcaataggacgtgggtggtccaacaactccggcgcctggacaaacctcacttgtctcggttcttcgacaccctgcagtagttctctagtgcatccattcattcattagtttttgcatatgc

SEQ ID NO: 1957 - DNA, 388 bp, Eucalyptus grandis
gtttcctcttcaggagaaagcaaggagctgtagaggaattgaaaatggtgcaagaagtccgaaagggtccatggacagaacaagaagatttccaactggtgtgctttgttggactttttggagatcgccgatgggattttatagcgaaggtatcaggtttgaaggtggcgggagaaaataataggattgaatagaacaggaaaaagctgcagactacgctgggttaactacctgcatcctggcctaaaacgagggaagatgacacctcaagaagagagactggtgctcgaacttcattccaaatggggaaatagatggtcgagaattgctcgcaagctaccagggcgaacggacaatgagataaagaactattggaggactcatatga

SEQ ID NO: 1958 - DNA, 455 bp, Eucalyptus grandis; identical to SEQ ID NO: 60

SEQ ID NO: 1959 - DNA, 965 bp, Eucalyptus grandis
aagagaaaagatacaatccgccgtggacccaagaaggtcaaagcccgctctctgcacgatgatgggtagtagtagtagtactacttatcttccgtgaggtctctcgaattagggttttcttgattttcgccaaccccccaatatttatcttttctttctttcctttttttcgcttctctcgcagttcacctagaaaagctacgagggcttcgcaccagttccgtacggggctgcttcagtgcgtagcgtgtactatctcgtctcaggtggtgtttcgcttttatggggatgtccttcggcgggggcgtttcgaagattcttgtagctccgtagcttgtcctgcgggatttggttgggccgatcgtcaggtttcttccagttaaagttgcgatttttaaggggagcgagggcgtttgagctggtaaagttcgaagctttttgagttcggccgccagggttgtgtcctagagataactggaggcgaaagggtgcgttccggtccggtcagcatccgctgactcaggagatggttgggggttgttggtggcggcggtgatgatgattcatgggtagtaggactagagttggcggtggtggagatgatggcagagttgtgaacggcatgccgagcttcgtccctcaattacccacttcgaattccatgggatcagaaggaaactccattcgttcttctcgaattacagactttggaacacttgagcagtctcttggataccgcatagaagatgcagttgacctcagcagaaatcctgtcttcaatcagatgaaatcaagtgcccaggctcttggggctgatgtccaatttggctctttgaataagtccctttcatcctcagacagaaatctttctgtgaatattgtggggtctcagactctatctatgcatagagaatcacaatcaaacttagtatcaatacccggtgctcatcgtgagaactgggggg

SEQ ID NO: 1960 - DNA, 599 bp, Eucalyptus grandis
gtccggtccggtctcctccctcccttcctccctccttccttctctctctctctctctctctctctcgccgtccaaccgtacggactctcggttttgccgcgaaacggaacggagcggacccggtccctcgccgtcgccggtgcgagagaatgcctcccccacgcgccgccacccccgacgtcgccggcgacgagagctccggcgccgacgccggcgccggggagatcatgctgttcggggtgcgggtggtcgtggactcgatgaggaagtgcgtgagcctgaacaacctgtctcagtaccagcacccgcaggacgcgaatccgcccaacgccagcggcgggagcggcggcaacaaggaagaggccgccaaaggctacgcatcggccgacgacgccgcgcacaaccccggcggtggccgcgagcgcaagagaggagttccttggacagaggaggagcacaggctgttcttgttgggattacagaaggtggggaaaggagattggagagcgatatccaggaactttgtgaagacccgcacgcccactcaggtcgcgagccatgcccagaaatatttcctgcgccgaagcaacctcaatcgc

SEQ ID NO: 1961 - DNA, 377 bp, Eucalyptus grandis
ggagaacgtggcttctgggtcgactgagcggccgagaattagacatcagcatagccagtctatggacgggtcgacgagtattaagcccgagatgcttatgtcgggttcagaggatgcatctgctgcagacgccaagaaggccatgtctgctgcgaagcttgctgagcttgcactgattgatcccaagcgtgcaaagaggatctgggcaaacagacaatcggctgcaaggtcaaaggaaaggaagatgcgatacatagctgagctagaacggaaagtacaaactttacaaactgaagcaacaactttgtctgcacagctgactctgctgcagagagacacaaatggtttgactgctgagaatagtgaattgaaactgc

SEQ ID NO: 1962 - DNA, 317 bp, Eucalyptus grandis
aagtaaaatcccctctcggctcctctttcttttatgtacattccaagaacagcgacagataaggccccgagatctgcaagtcttcttcacactactcgctgatggctgattctgaacattcttcttctgatgacacttacgtggactctagagaagagacaagtgaagaatcaaagctagatttctctgaagatgaggagacgcttgtaattagaatgtacaacctggttggagaaaggtggtctctaattgctggtagaatcccagggaggacagctgaagaaatcgagaagtactggaattccagatattcaaca

SEQ ID NO: 1963 - DNA, 471 bp, Eucalyptus grandis; identical to SEQ ID NO: 74

SEQ ID NO: 1964 - DNA, 372 bp, Eucalyptus grandis
tgacactgaagattcgaagaagaaagagaggcatattgtgacttggtctcaagaggaggatgatatactccgggagcaaatcggtatacatggaactgagaactggtcgattatcgcatcaaagttcaaggataaaacgacgagacaatgcagaaggagatggtacacatatttgaattctgacttcaagaaagggggttggtcacccgaggaagatgtgcttttatgtgaggctcagaagattttcggcaacagatggacagaaatagcaaaggtggtttcaggcaggactgacaatgccgtaaaaaatcggttcacaaccttgtgtaagaaaagagcaaggtacgaagccttagcgaaagagaatacact

SEQ ID NO: 1965 - DNA, 424 bp, Eucalyptus grandis
atgcaattttgagcgtcgcgagtaagccggagcgaggggagagcgatgggcaggcagccgtgctgcgacaagcttggggtgaagaaagggccgtggacggcggaggaggaccggaagctggtcaacttcatactcacccacggccaatgctgctggcgggccgtccccaagctcgctgggctccgccgctgtggcaagagctgccgcctccgctggaccaactacctccgccccgatctcaagcgtggcctcctcaatgaagccgaggaaagcctggttatcgatctccatgccactctcggcaataggtggtccaaaatagcagctagactacccggaagaacggacaacgagatcaaaaaccactggaacacccatatcaagaagaagctcattaggatgggcattgatccagtcactcaca

SEQ ID NO: 1966 - DNA, 427 bp, Eucalyptus grandis
cccggctcccgctcgtccaatcggcgcgtcgagaggaagaaaggtaacccatggacggaggaagagcatcgaaggtttttaattggtctccagaaattgggtaaaggagactggcgagggatagctcgtgactttgtgactacaaggactcctactcaagtggcaagccatgcccagaagtattatatccggcagagtaatgctggccgaagaaagaggcgctccagcctttttgacatggctccagatatggtttgtcttctctatgatgttgcttctgcacattcattgcactccgttcaaatatccggctcgtgcatgttttaagatgttttcttagctcatgctgacatatgctttaaccatgcactagtgatgattacatgataagggccattcctcttagacctttgggacacatcaaatg

SEQ ID NO: 1967 - DNA, 373 bp, Eucalyptus grandis
cttgaaacttctccgctcttctcttctctctcttgaaaggaaggatgagaaaaccttgttgtgacaagcaagacacaaacaaaggagcatggtcgaagcaagaagaccagaagctcatcgactacattcgcaagcacggcgaaggatgttggcgaactcttcctaaggctgccggtctcctccgttgcgggaagagttgtaggctaagatggataaactatttgcggcctgacctcaaaagaggcaactttgctgaggatgaagaggatcttatcatcaagcttcatgctctcctaggcaaccgatggtcgctaattgctgggagattgcccggacggacagacaatgaagtgaagaactattggaactcaca

SEQ ID NO: 1968 - DNA, 197 bp, Eucalyptus grandis
ggtcgcccgaggaagacgagaagctcttcaactacatcacccgattcggcgtcggctgctggagctctgtaccgaagctcgccggactccagagatgtggaaagagttgcaggttgaggtggataaactacctgaggcctgacctcaagagggggatgttctctcaagaagaggaggatctcattgtcagtctccac

SEQ ID NO: 1969 - DNA, 365 bp, Pinus radiata
gcaaaatcttatttgggttcccttacagaaactatacagtccctgaatgctgagcttgaaagaactagatcggagttggttgaagcaaagaagagagaggaagagattatttcaaaagaagctgaaagagtagagaagaataagagagaagtggaaaatctggaactcaatcttctgcaaactactgcagaagctgggcgagctaaactggaactagagactgcttatgaagaggtgcagagcgcaagacttgaaactgcgcaattgagggctgctttggaagccacagagggaaaatttgaagcaatgctgagtgagactaggttggaggcagagcatgtcaaaggagctattgagaagtataa

SEQ ID NO: 1970 - DNA, 260 bp, Pinus radiata
gaaatattggtgactcaaatagagcaacttcaaagaaaggaacggatgtttagcgaagagaataattttctccgaaagcggattgtcgatccccattccgttttgacaactcctgcaagtggatctggaagcctccaaagaagtgaagtcgagactcaactggttatgagaccgcccagttcaaatgctgattttctttttaatagttctcattgataatcactgtattcatatctttgttattaatttattatgaaatg

SEQ ID NO: 1971 - DNA, 332 bp, Pinus radiata
tctctctggtgtggggggcactcaaaatggggaagacgaagatggagattaaacgcattcaaaaccctagccgccgccaggttactttctcgaaacgcaagaacggattgctaaaaaaggcattcgagctttctgttctctgcgatgctgaagtcgccctgatcattttctcggaaactggcaagatctgcgagtttgcaagccacgacgacatggcaacaatactggaaaaatatcgaatatacacggaaacacatggaaacatggagtcctcgtcggtccaaagcgtgaagattggtgaatcacaactcaaagcgttgcgtgagaagatg

SEQ ID NO: 1972 - DNA, 413 bp, Pinus radiata
cttcgaggtgctaatggctgcacaataccttcaattggattgacaagcatagaacgcgtggaagttcagactcaactggtcatgagacctccacatgccacagagatggacgacaactttatggatgttgacaacgtgccactatctggatgatgtttttctgtttctgttacataatatggccactgatgacaccatactttattttggtatttgctttaaaaatgactctttctttcactgacttttgatggactgtatgatagttgatttttggtcctcatactttagcaaatggttatgggtacctgttttggcccgaggccttggaggatctactctctatatgttactgttttactttttacatttgtgctcactgactcatatgatggacttgcccacatatgatg

SEQ ID NO: 1973 - DNA, 521 bp, Pinus radiata
agaagatgggagcttggtgatctgtgaaagatctctctctgcggctcaaggtatgcctatggtatcacagtctcaaagctttgtgcatggtgaactcttatctagtgggtatttgatccgaccctgtgaaggcagaggagcattagtcatcatggttgatcacaggaacttagaggcttcaagtgtccctgaagcacttcgtcccttatatgagtcatctacattctttgcacagaagatgacagttgaggcttcttatcatcttcaaggtaaagttcaaccggaaatgatttccttatcaaaaaaactccaacagccatgtaatgtacggtcatacagtcaacggctttgcagaggctttaatgaggcagtcaacacattacctgatgatggctggatgtcattgtccaaagatgggctgggggatgtcactatttgtgtaaagtctttgtcaaattgccgaaaccaaatgtcatcgtcaaatagcctatgttcaacagacatgggcatcttgagtgaaa

SEQ ID NO: 1974 - DNA, 461 bp, Pinus radiata
gaaaatgaaagccttcgagctcgtttaaggcatatgaatggcgatgacatcaattcgttgaagcttcccgaactcttccatctcgaacagcagcttgaaacggccgcaacccaagttcgaagaagaaaggatcaagttttagacaacgaaaaaatcaagcgaaggaacaagatgcgccgtaaggaagacgagaacatcattcttcacgaaatgcttgaccagcaccatggacaaatggaggaggataacgctcagattaatttcctattttgccaaccattaaatagatcggatactactttccctgcatcactactccgcctgcaaccaaatcagccaaatttgcaggatattggatattaattactgaacggaccatctgtgtgcatcataatgagaaggtcatggacttctcagtaacagtcaattatgaaaattcgaagtttgtgaggaaaaaaaaa

SEQ ID NO: 1975 - DNA, 499 bp, Pinus radiata
tgagcccccaggtggagcaccgacctttcagcccacatgaagacgccaccatcatacaagcccatgcgcggcatggcaacaagtgggctacgattgcccgcctcctacccgggcgcaccgacaacgctatcaagaaccactggaactcgactctgcgacgtcgctatcatggcgagaaagaccagagcaacgggctagctgtgaacttggagtcggcagctgaggacaaagaaacgatgactccgatgacacctgtcacagccacggcaacggcaacggcaacggcaatgccagtggctttagtgttcccaacggctgcagacaacgtcaggaagcggagcaacagtagctgcagcgctaatgacaatccaggagatgccgaggtcgaatcctgtaggcttaagaggctcaatttttctgaatccccatctagttctgaaaatattaataataataacaataatgaagaagctgttagtggccattgcaattcggccgc

SEQ ID NO: 1976 - DNA, 419 bp, Pinus radiata; identical to SEQ ID NO: 399

SEQ ID NO: 1977 - DNA, 459 bp, Pinus radiata
gcaagctggcctccagcgttgcgggaagagttgcaggcttcggtggatcaactacttgagaccagatctgaagcgaggcacattctctccgcaggaagaaaatctcattgttgaactgcattcagtcctcgggaacaggtggtctcaaatagcaacacacctgcccggaagaactgataacgagatcaagaacctctggaactcgtgcattaaaaagaagcttaggcaacgaggcatagatcctaacacgcacaggcctctcagcgaggtgaatgccgaggcaggggattctaagaacgataacagcaataaagaagtcgaaactcaggcagccatggacgaatctcatgtttctgcagggaacgaattcaagcatctgaatgcaattcctagggctgatacggccaatcctaaattctttcatgttcccgttgaggacaacactttgattgctagcga

SEQ ID NO: 1978 - DNA, 331 bp, Pinus radiata
ggagagtgcaccaccgagatccacgcagtcgaagagaaagagaaatctgcaggaggagttgaaaatgaggtgcacacgatggcaaggtctcccattttcctccaaaccaaaagttaaaaagggtctctggtcgcctgaggaagatgagaaactcatcaattatatgatgaagaacggccttctcggctgctcctggagctatgtggccaagcagattggtctgcagagatgcggaaagagttgcagactgagatggactaactacttacgtcctggccttaagcggggtgcaatttcgcctgaggaggagcaattgatcatacacttacag

SEQ ID NO: 1979 - DNA, 375 bp, Pinus radiata
gttctatcaaacttcttatccaccatacccatttccattagacggctgaattctcagatccaatttgttccagccctctagcgacagaagaagatgggaagagcaccctgttgtgacaaggcaaatgtcaaaaaaggaccttggtcaccagaagaagacacaaaactcaaggcgtttattgaacagcatggcactggtggcaattggattgctcttccacagaaagctggtctgaaaaggtgtggaaagagctgcaggcttagatggttgaactatttgaggccagatataaggcatggtggtttctcagaagatgaagataacatcatttgtagcctctatgcaagcattggaagcatggtgtctataattgca

SEQ ID NO: 1980 - DNA, 749 bp, Pinus radiata; identical to SEQ ID NO: 361

SEQ ID NO: 1981 - DNA, 339 bp, Pinus radiata
cttggctggggaagacaacccgctgcattacggacatttagccagagattgtgcaagggtttcaatgaggcagttaatggcttcacagatgatggatggtctttgatgggtaacgacggaatggaggatgtaactattctcgtcaattcatctccaagcaaactgttcggtcaacagtttgcttcttccgatgggcttcctgctcttggtgggggcatcctatgtgccaaggcttctatgctattacagaatgttcctccagcattgcttgttcgtttcttgcgagaacatcgatcagaatgggcagatagtaatattgatgcctattcagcagcctct

SEQ ID NO: 1982 - DNA, 373 bp, Pinus radiata
ggattccgacccttccggctaaagctgcttcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcatcatcaaactccactccctactcggcaacaagtggtctcttattgcaggcagattgcccgggcggacggacaacgagataaagaactactg

SEQ ID NO: 1983 - DNA, 404 bp, Pinus radiata
aggcaataagtgttattattgagaacttgactgtggctgagattttcagggatggaccgttcaaactctgcgactggagaagaagatgtactgtcaagatgcagggaaagaaaacgtttcatgaagctggcaattgagaacaggtataaactagcaacagctcatgtggcttacatggattctcttaggcgtatgggcaccggtcttcggctttttgctgaaggcgaaacgatgtcggagtcttcctattccacatcacccatagggacttctgaacttgctgttgtcttgcctgagaaatccgtatccccatctccatttccatcctcatccccttcactttctcaacctcaaagtccccgttcagagagagcagaatctcgatctccactcgacagcttctc

SEQ ID NO: 1984 - DNA, 332 bp, Pinus radiata
cggacggcttggttcaaaactctcgtgaaagaaaaaaaggcgttccttggacggaagaagaacataaaatgtttttattagggcttcacaaattgggaaaaggcgactggagaggtatttccagaaactttgtcacttccagaactcctactcaagttgctagccacgcacaaaaatattttcttaggcagagtaatttgaacaaaaggaaacgaaggtcgagcctgttcgatatatccactgattcgatggaagattgctatcaaggaatcccggagctgtcaccggtgatgcacgatctcagcctgggccagaattcatctctgacctct

SEQ ID NO: 1985 - DNA, 526 bp, Pinus radiata
ctcctctcccgtctccaaacccaagctaaggaaaggcctctggtcgcctgaggaggatgataaactcatcaactacatgatgaaaaacggccagggttgctggagcgatgtcgccaagcaagctggtctgcagagatgcggaaaaagctgtaggctgaggtggattaactatttaaggcccgacctcaaacgcggtgcattttcaccccaggaagaacaattgatcatacacttgcattccattctcggcaacaggtggtctcagattgcagcccgtttgcccggacgtacggacaacgagatcaagaatttctggaactcctgcataaagaagaagttgaaacacctttcggcctccaccaacaacagtaaatctatctctgcacctaatcgtaccagtaccatgaattcatcgatcacgcccttttctgaatcgtctgccgagccattggaggtcatggcaacaaggtatcagccatcgaatgcttttaatcatgaagtgcccactgcagaaaatcaagttttg

SEQ ID NO: 1986 - DNA, 366 bp, Pinus radiata
atcagactcacatcaaacgaaactggagccgtgaagggttagttgcggtgttaaattctaggacagctttccgtattagaaagaggcgccctttacgggagtcggcaccaaaccagagtggagagaaataatgggtagggctccctgctgcgaaaaggttgggctcaagaagggcccctggacgccggaggaagatcaaaagctcctcgcttacatacaggagcacggccatggcagctggagggctctgcctcagaaagctgggttgctaagatgcgggaaaagctgcagattgcgttggactaactatctaagaccagatatcaagcggggaaagttcaacccacaggaagaacagacaattat

SEQ ID NO: 1987 - DNA, 476 bp, Pinus radiata
ccgaactccccgctgtgatcaaatgggattaaaaaagggaccctggacacctgaagaagatcaaatactcatctcctatatcaacaagcatggtcatggaaattggcgtgcgctgcccaagcaagcaggacttatgcgatgtggaaagagttgtcgcctgcggtggacaaactatctgagacctgacataaaacgtgggaacttcagtctcaaggaagagcagactattattcatctgcatcaaatccttgggaaccgatggtcagctattgcctcacacctccccggaagaacagataatgagataaaaaatgtatggaacactcatttgaaaaaacgcctcctgcaaattggggtagacccagtaacccacgcgcctagaggatacaatgtatctaactgttacaccgctgtgaatatccgggaccatcatggcgagcaggccgatcatcagctccaaagccatgtctgcgttt

SEQ ID NO: 1988 - DNA, 151 bp, Pinus radiata
ggacacctgaggaagatcgaattcttatctcctatataaaaaggaatggccatggaaagtggcttgcactgccgaaacaagcaggacttagccgatgcgggaagagttgtcgactgcggtggacaaactatctgagacccaacataaaacg

SEQ ID NO: 1989 - DNA, 461 bp, Pinus radiata
gtaacccatcaggagttctcttctgtccaacccccctaactctccacttcacagatctcatgagacttaacctgttctaacgttgcagggcaataaccctctttgtctcttgttctgtattttttgctttttgaccacagagcaggttcaacaagcttgtacaaaggacgcactgaaaatgaaggatttttactgcagcttatgttaaggtttattttatataaacgatgggaactggggaagaagcaacgccaactaagcctgctgccaaaccatcttcctcctcccaggagacaccgacaacacctgtttatccagattgggcagctgctttccaggcatattatggtccaggtgctaccccacctcctcctgccttttttgcttcaacagtgggatctgcaccaactccacatccatacatgtggggtggacagccgttgatgccaccttatgggact

SEQ ID NO: 1990 - DNA, 418 bp, Pinus radiata; identical to SEQ ID NO: 344

SEQ ID NO: 1991 - DNA, 321 bp, Pinus radiata
actaaagcagctataaagagactgcagtctcagataatggttgcattccaggcagttgatacaacttctgcagcaattctgaaattgagagaagatgaactctatcctcaactcgtggagctatctaaagggctaatgcagatgtggagggccatgtatgaatgccaccaggtccaaaatcatattgtccaacaggtgaggcatttgggcaatctggcaagcgcagaggccacaagtagttaccatcagcaggcaaccattcaattggaagctcaggtgactgcttggtatgacagtttttgtagaatgataacgagccag

SEQ ID NO: 1992 - DNA, 390 bp, Pinus radiata
gagaaaacctaagtcctctcgcagcaagcaagccacgcattccctctctacgactcgggtttggtgtagaaggcagagatttactttgtttctgcttgtttgtcggtcttcaccttcaccttcagacaacatttgtctgaaccgcggaactagctcttgaaatattgaaacccacctaaatcgcaggggattggtggatgttagcagtggtcacagagcggtagagctagggaaaatccatatacaactacatacacagatacccattatcagccatgggcgctccgaagcaaaaatggacatcagaagaagaaggtgctctgcgagcgggcgtggagaagtatggcgccggcaagtggcagaccattctcaaggacccagagttcgcct

SEQ ID NO: 1993 - DNA, 476 bp, Pinus radiata
gcagtggtcatatggatgggggatccggagaggaccaagatgccgccgatcaagatcacgatcacgatcacgatcatgatcacgagcagcagcagacgcggaggaaacgttaccacagacacactgctcgtcaaattcaggagatggaagcgttgtttaaggagtgtccacatcctgatgacaaacaaaggcagcggctcagcattgaattgggccttaagccgcggcaggtgaaattctggtttcaaaatcggcgtactcagatgaaggctcaacaggatcgctcagacaacgccattctccgtgcagagaatgaaaatctgcggaacgagaacgtagcactccgagaagcaattaaaaatggtgcttgtccaaactgcggagggtctacatcgctgggagagatgcctggattcgacgaacaccatttccgtatagagaatacgcgcttaaaggaggagcttgatcgagtgtct

SEQ ID NO: 1994 - DNA, 429 bp, Pinus radiata
gataaactgagtgagcaaaattactcagaaagaaggaagagcagaacaattcgcccggaggaatgggttgcacacaagggcaacgacaaggggaatgggaagggaaaggcgtcccctcgaattcctcaaggcgaagtctaagaaaaggtctctggtcaccggatgaagatatagaacttaccacctatatcatgagaaagggcctcatgggctgctggaactatatcgccaagcaggctggtctgcagagatgtggaaagagttgcaggctgagatggattaactacttgcgacctggtcttaaacgttgtgcaatttcaccccaagaagagcgactgataatacagttacaatccagtctcggtaacaggtggtctcaaatcgcggcacatttaccgggacgcacagacaatgaggtcaagaattact

SEQ ID NO: 1995 - DNA, 321 bp, Pinus radiata
agcgcgtctctgtgaaaatggggagatctccgtgctgtgagaaggctcacaccaacaaaggtgcctggacccaacaagaagatacccgccttgtcgcccacattcgagcccatgggcaaggcggctggagctcgcttcccaaggcagcaggactgctgcgctgtgggaagagttgcaggcagcgatggataaactacctgcatccagatctgaagcggagtaacttttcagaggaagaagatgaactcatcgtcagactccattcgctcctgggaaacaagtggtctcttattgcggggagattgccggggaggacagaca

SEQ ID NO: 1996 - DNA, 402 bp, Pinus radiata
ccgcctcctacccgggcgcaccgacaacgctatcaagaaccactggaactcgactctgcgacgtcgctatcatggcgagaaagaccagagcaacgggctagctgtgaacttggagtcggcagctgaggacaaagaaacgatgactccgatgacacctgtcacagccacggcaacggcaacggcaacggcaatgccagtggctttagtgttcccaacggctgcagacaacgtcaggaagcggagcaacagtagctgcagcgctaatgacaatccaggagatgccgaggtcgaatcctgtaggcttaagaggctcaatttttctgaatccccatctagttctgaaaatattaataataataacaataatgaagaagctgttagtggccattgcaattcggccgc

SEQ ID NO: 1997 - DNA, 375 bp, Pinus radiata
ttagcttgcagaaaatgaggtgcaaaacagggcaggcacaaggcgtattggaagttgaaggcactcaccctgctccttccaaaccaaagttaagaaaaggtctctggtcacctgttgaagataaccagctcaccaactatatcctgagaagaggcctcgtcggctgctggaactatgtggccaagcaggctggtctgcaaagaaccggaaaaagttgtaggctgagatggattaactacttacgccctggccttaaacgtcatccaatttcacgccaagaagagcagctcatcatagaattacaatccattctcggtaacaggtggtctcaaattgcggcacagttgccgggacgcacggacattgagatcaaga

SEQ ID NO: 1998 - DNA, 466 bp, Pinus radiata
acaacagcttgaatctagtcgaataaagctgaaacaaattgaacaagagcttgagcgagtgaagcaacagggaatttccatcaatggacatttgggcgatcataatggatcaggggctgctgcatttgatatggaatatggccgttgggttgaagaacaaaacagacaagcccgtgagctcagggcttctttacaagcacacctgacagatagcgaactttgtgttctggtggataatgctatagctcattatgatgaactctttcgtatgaagggtgctgcttccaagttggatgttttccatcttatgtcaggcatgtggaaaactcctactgagcgttgttttatgtggatgggaggttttcggccatcagagcttctgaagattcttactccacaaattgagcctttaacagaacagcaatcattcgcagtatctagcttgaaactgtcatcacagcaggca

SEQ ID NO: 1999 - DNA, 243 bp, Pinus radiata; identical to SEQ ID NO: 368

SEQ ID NO: 2000 - DNA, 642 bp, Pinus radiata
cgagcgcgaaagactgaaatattggtgactgaaatagagcaacttcaaagaaaggaatggatattaagcgaggagaatgctttcctcggcaaaaagttcgtgcatcctcattccgtttcgaaaactcctggaagtgaatcgggaagcatccaaaacagtgaagtcgagacgcaactggttatgagaccgccatgtacaaatgctcattttcttattaatagttctcattgataatcaatgtattcgtaactgtgttatcaatttattatgaaaattttatattaataaaaggtaaagctgcttctcatatcgcacctaattgttcaccacgtccaaaaaaaggctcttgccaagtgaactaaatgttttttgaaccgaagtctgtcttccaaactcagtatgtaagcttgctatgaatacatactttaaaggttttgtattagcattacgagcggagttttcctcattcatccgatgagcatgaagagtgaggagtataatattgacgcatgtggagaatttaatgttgcatatactcctacgtgtatatatgtgatgttttatatatatatatatatatatataatatcgatttgaatctataaaattttaaattatatatttagtttaaaaaaaaaaaaa

SEQ ID NO: 2001 - DNA, 485 bp, Eucalyptus grandis
gagagagtctgcaaactgcgcgtcccgcgtcgccgatcgccgggagaatcgccgccggcgagatatggggaaccagaagctgaagtggacgaaggaggaggaggaggcgctcctcgccggaatcgccaagcacggcgccggcaagtggaagaacatcctcaaggaccccgaattcgcccccgccctcgtcaatcgctccaacatcgacctcaaggacaagtggcgtaacttgagcgtcggtacttctggacaaggttctagagataaacaaaggctgtcaaaagtgaaaagtctgatggccgctcctcagtccagtaccgtgcctctaaatccacaagctcatgctgcatctactgatgttgcattggtcaattcttcaaatagctttcaagatggcaaaaattattcactgtgggtatctgtgctccttttccttttcagtaacggcaatcttttttacttctatcctttgttatcctttctgt

SEQ ID NO: 2002 - DNA, 356 bp, Eucalyptus grandis
cgactcgtcagtcagctcgtgcactccttgcaattcatgattatttctcccgacttcgggcccttagttccctctggcttgcccgtccaagagaatgaagaggtcatggtctatgcaggctgacatgtacattggtgatctttaggaagctatcagttttgaagtagtttcggacctagaactggtttatttctagttttcttcattttttttttctttggctataattattttttctttcttagacacgaagtcacagagaattgattgatggtatgctaagctatcataggttgggattgcattgttctcattgaagatactgctaattgtgtaggcactcctgttcattagtc

SEQ ID NO: 2003 - DNA, 713 bp, Eucalyptus grandis
tctccatccaaattcccaccttcctcccttcctccctttccccctttccttccttctgcaccgaaggaagcccccgcttcgcaagccacctctcggtaaagttcgctcctttttgggtcggcgaatcttgggtcgatcgatggcttcgaggaaggaggtggatcggatcaagggaccgtggagccccgaggaggacgaggccctccgcctcctggtgcagaagcacggcccccggaactggtccctcatcagcaagtccatccccgggcggtccggcaagtcgtgccgcctccggtggtgcaaccagctctccccgcaggtggagcaccgggccttcaccccggaggaggacgacatcatcgtccgcgcccacgcccggttcggcaacaagtgggccaccatcgcccgcctcctctccgggcgcaccgacaatgccatcaagaaccactggaactccaccctcaagcgcaagtgctcccccccgctctccccgctcgccgaggaagggaacaacagggcgttcgacgctgccgcggggtacgacggggacttgagcccgcgggagcggccggcgaagcggtcggcctccgccgggccttgcctgagccccggcagcccgtccggatccggcatgagcgactccagcgtgcacttcgtgtaccggcccgtcgcgaagaccggccccgtggtgcccccgacggtcgaggcgacgg

SEQ ID NO: 2004 - DNA, 341 bp, Eucalyptus grandis
acaggttgctcaattaagagttgagaattctactttactgaaacgtctctcggacataagccagaagtacaatgtagcagctgttgacaacagagttttgaaagctgatgtcgaaaccttgagagcaaaggtgaagatggctgaagagacggttaaaagagtaaccggactgaacccaatgctgcatgtgatgtccgacatgtcttctgtgggtgtgccaccatttgatggtagtccttctgatacatcagcggatgctgcagttcctgtgcgagatgacccaaagcaccaattctatcaaaccaattctagtaaccccgcatcatctgctgacgatatga

SEQ ID NO: 2005 - DNA, 1403 bp, Eucalyptus grandis
ttctttcttcaccctctgtgcatgaattttcttgggccatgctcatgcattctcctcctctttcttcatcaccatcgtcatcgtctctgactttgatgggttggcgagggggggagctgagggagagggagaggagaggagagaggagcggctgtgcgttcgcgtgcagggctgcacgaggtgttctcgtttcgggcgcgggcgctctgcttccatggctgcttttaagtaagacgccaaaagaaaacctttttgctctctcgagtgtcatgaactcgcactgaaagtgcgcgccgaaccgagaagaagaagaagaagaagaagaagaagaaagagaaaccatccccttagaaaacgcgaaaaagagtaaatagtaaaaagagcaagcttgatcttacttgatctaaaacattaagatccttctctgttcgagagaagtcacagtcccgctttttccagacatgaagagacttggcagctcagattcgttgggtgctttgatgtccatctgcccaccttcagaggaattgcagcacagtccgagaaacggcaaccccatctaccacagcagggacctgcagtccatgctggagctgggcctcgacgaggaaggctgcgtggaggaccagtccgccggcggcggggggcacgtcggcggcgagaagaagcggcggctgagcatcgaccaggtcaaggccctggagaagaacttcgaggtggagaacaagctcgagccggagcggaaggtgaagctggcccaggagctggggctgcagccgcgccaggtggccgtgtggttccagaaccgccgcgcgcggtggaagacgaagcagctggagcgggactacggcgtgctcaagtccagctacgaggcgctcaagctcagctacgacgccctcaagcacgacaacgaggcccttcacaaggagataaaagagctgaaatcgaaactccgggaagaagacgacaaccccgagagcaatctctccgtcaaagaagaggtcatcatccccggccacgacgtgtcggacaagatccgggccgcagacgacggtgacgacgacaccaaacgctctcctccccctccgatcaccgccccgcctcgcgagctgagcttcaacaatggtgggctgaaggacgggtcgtccgacagtgactcgagtgcaattgtgaatgaagagaacgcggcgaccagcagcagcagcccgaaccccgccgtccagagccacggcggcttcttgaaattcatggggtcatcgtcctcttcggcctccccaccgccgtcgccaccggcttccttcggcgggtgcttcagcttccagttccagcgagcgtaccagcctcagcctcagcctcctcatcaccaccaccaccacagtccgtacgtgaagatggaggagcac

SEQ ID NO: 2006 - DNA, 283 bp, Eucalyptus grandis
gagaggtacaagagtgcatgcagtgattcctcacatccacagtccgtttctgacgtgaacactcagttttatcagcaagaagcatccaagcttcggagacagataagagaaatccaggtctcagataggcatcttctaggtgagggtataagtgatttgagcttcaaggatctcaagaatctcgagagcaaattagagaaatcgatcagccgtgttagatcaaagaagaatgagatgctttttgccgagattgagtacatgcagaagaggggccttgtgcagg

SEQ ID NO: 2007 - DNA, 252 bp, Eucalyptus grandis
agagaacaagataaacaggcaggtgaccttcgctaagaggaggaatgggctgctcaagaaggcctatgagctctctgtcctctgcgatgctgaggtcgccctcattatcttctccacccgcggcaagctctatgagttctgcagcagccctagcatgctcaaaacgctcgaccgttaccaaaagtgcagctatggatccgttgaagttaacaaaccctccaaagaactagagaatgcctaccgggagtactt

SEQ ID NO: 2008 - DNA, 386 bp, Eucalyptus grandis
tctagatccaccaccagcagaaggaggtagaagggggagaaggaggagaaggaggaggagatgggtagagggaagatagagatacagaagatagagaacgacacgaacaggcaagtgacctactcgaagcggaggaatggcatcttcaagaaagcccacgagctcaccgtcctctgcgacgctagggtttccatcctcatgctctccggcaacaagaagctccacgagtacatcagccccaccaccacgacaaaaaggatgattgatgattaccagaaggctcttgggatcgatctgtggactacacactacgatagaatgcaagaggagttgaggaaactgaaggaggttaataacaattttcggaaggaaataaggcagatatt

SEQ ID NO: 2009 - DNA, 123 bp, Eucalyptus grandis
gagaaaccttatgggggaagatttggggaccttgaactcgaaggagctcgagcagctcgaacgtcaacttgaggcatcattgaagcatattaggtcaactaagactcagtgcatgctcgatca

SEQ ID NO: 2010 - DNA, 581 bp, Eucalyptus grandis
cttagggctagcttgcttacatcttcaccatcttctgcgtagtttcaacattttagagttgaagaaaaggagaaaaaactaggcaaacttgcgaccatggtttttccaacccaagccacgcccgaggagtccccgcagaggaaaatggggaggggaaagatcgagatcaagcggatcgagaacacgacgaatcggcaagtgactttctgcaagcggcggaatggcctcctcaagaaggcatatgaactctccgttctttgcgaagccgaggtcgccctcatcgtcttctccagccgcggccgcctctatgagtatgccaacgatagtgtcaaagcaaccatcgagaggtacaagaaggcttgctcagattcctccagtagcggatccgtttctgaagctaatgttcagttttatcagcaagaatccgccaagttgcaacaacagattaataacatgcagaacaataacaggcaactggtgggtgactcaattgctgggatgaatatgaaggatatgaagactacggagcaaaaactagaaaaagcaatcgctaaaattcgcgccaaaaagaatgcgatttt

SEQ ID NO: 2011 - DNA, 538 bp, Eucalyptus grandis
tcagcacaaggaacaaatgctggttgaagctaacagagaattaaggaagaagctggaagagagcaatacaagaatccctctccgccttggatgggaagctgaggatcacaataacatttcatacagccgccttcccatgcagtcgcaaggattgatcttccagcccttaggcggcaacccgacattgcagatcgggtacaatcctgcaggctcgaatgaattgaatgtttcggctgccgaccaacatcccaacggattcattcccggatggatgctctgaatcgttccgcaagtgaactgcttgctggaagttccatatcaagtacattttccagtttttgctatgatatatgactcttcttcttctggatgacctatacgaagatccatcattcgtggatattgtccatggacgtaccctaaaaggaaggacagtatgaatccaatctagcttactattttgtataagaataaacatctgtgctgctgatatttggaattcatctatgttatttaatgaaaaaaaaaaaaaaaaaaa

SEQ ID NO: 2012 - DNA, 341 bp, Eucalyptus grandis
aggcagcaaagagctcgagtccttggaaagacagctagatgggtcattgaagcagatcagatcacgaagaactcagtacatgttagataagctgactgatcttcaacatcgggaacagttgctccacgaagcaaacaggaccttgaatcaacggttgatggaaggataccaagtgaatgcgctccagttaaatcaacatgccgaggaagtcggaggatacggtcatccaccgccgccgccactgccgccacagccacttgctcagcctcacagcgaagcttttttcaatcccttggaatgtgaacccactttgcaaatgggataccagcccgatccagtgt

SEQ ID NO: 2013 - DNA, 934 bp, Eucalyptus grandis
gcgccatgacgcggcgatgctcccactgctgcaacaagggccacaactccaggacctgccccgtccgcggcggcggcggggacggcgggggcgcggcggccgccccctcctcctcctccccctccacctcctcctctggcgccgcggcggcggcggcggcctcggcctccggcggcggggtgaagctgttcggggttaggttaacggacgggtcgatcatgaagaagagcgccagcgtggggtgcctgtccgccgcccactaccactcctcgtcctccgccgcggcatccccgaaccccggctcgtccccgatcgacgggagcgacggctacctgtccgacgatcccgcgcccggctcccgctcgtccaatcggcgcgtcgagaggaagaaaggtaacccatggacggaggaagagcatcgaaggtttttaattggtctccagaaattgggtaaaggagactggcgagggatagctcgtgactttgtgactacaaggactcctactcaagtggcaagccatgcccagaagtattatatccggcagagtaatgctggccgaagaaagaggcgctccagcctttttgacatggctccagatatggctactgctgaccaaccctcacatccagaagaaacatttctgcctcctttggtcagacttaacgatgatactaactcaacaacttcaaccagtatgggactcgatttggaaagaacgcctatggagacctcgcacccagaaacatctgaagggggcggtgatgttgcgatggaatcaattgatcaagtacctcttgtaccctgttacttcccatactatttaccactaccctttcccatgtggccgcccaacatggcgcctcctgaagatggaagggtggtggagacatctcatcaccgtgtgctaaagccaatcccagtaattccaaaaga

SEQ ID NO: 2014 - DNA, 372 bp, Eucalyptus grandis
ctgggacacttcttcttcccctcctactttacttgaatcggtcgacaattttatcctgtctccagctagaactggaaaggctgaatcagagtgtctttctccccgtaatagtgggctgctggatgctttagttcacgagtcgaagactatgagcagtgccaaaaataattcacctgaaaaaagtacaaattcatctgctctgacacctggtgatataagcagttccactttggatatttgcaagtctgaatgggaagagtatggtgaccccatttctccaccgggccattctgcaacttcagttttcaatggttgtactcctttgagcactagtggaagctcactggatgaacaaccgtatcccgatacctt

SEQ ID NO: 2015 - DNA, 411 bp, Eucalyptus grandis
gcacataagaaggaagctcttgaaccgagggatcgatccggcgacgcaccggccattgaatgagcccgcccaagacgcaaccactatttcgttcgcagcggctccgtcaaaacaagaaccgcgagacgacgccatcgccgccgcgctcggctacaagaacgagaacaacccgacaacaacggcagcaacggttcaagaaaagtgtcccgacttaaatcttgagctcagaataagccctccttgccagcagcagcatcagcctgatgcgtcgatgggaatggttgagggaaatcactgctttgcctgcagcctggggttgcagaacagcaaggagtgcagttgcaggagaggagcgagcgggggaagcagcgcccatggcggctacgactttttggggttgaagacgagccg

SEQ ID NO: 2016 - DNA, 356 bp, Eucalyptus grandis
ctcgtccccaaggtttttttgcggaagtatggagttcccgagtgaattttcagaggcctcttcacagaagagaatcggggggagagggaaaatagagatcaaacggatcgagaacacgacgaaccggcaggtcaccttttgtaaacgccggaacgggttgttgaagaaggcttatgagctatcggtgttgtgcgatgctgaagtggcgcttattgtcttctcgagccgtggcaggctctatgaatatgctaacaacagtgtcagaggaacaattgagaggtacaagaaagcaagcagtgattcctccacatcccacagtccgtttcctgaagtggaacactccagttttatccagc

SEQ ID NO: 2017 - DNA, 356 bp, Eucalyptus grandis
agagagtaatggggagagggagagtggagctgaagaggatagagaacaagatcaacaggcaggtgaccttctcaaagaggaggaatgggctgttgaagaaggcctatgagctctctgtgctgtgtgatgttgaggtcgcgctcctcatcttctccagccgtggcaagctctatgagtttggcagcgctggcccttctggcataaataagacgcttgaacgataccaacgtgacaacttcactcctcaagacaacgttgctgaacatgagacacaacagaactggtttcaagagatatcaaaattgaaggcaaaatatgaactcttcaacaaactccagaagcatttgcttggaaaa

SEQ ID NO: 2018 - DNA, 495 bp, Eucalyptus grandis
caaggaagcaacagtcttgctgcaaccagaagctagttcaaactagtggaaggttgtgggcgcttccagtgctttgtaaagccaccccaagaaagcaaaaaccatcgttgccctaccacaaagttcgcagcgttcgtcgacgagaggagtctgttgatttatccaagtgttgtttaaagtagatctcctttttcggtgaacatggctcgtggaaaagttcagatgaagcggatcgagaacccggtgcaccggcaggtcaccttctgcaagcgccgcgcggggctcctcaaaaaggccaaggagctctccgttctctgtgacgctgacatcggcctcttcattttctccccccacggcaagctctatgagctggccaccaaaggaaccatgaaggggctgatcgagaggtacatgaagaccacccaaagccaagctgctctgaccgaggaagccacaccgagccaaccactggatgccaaagaagagattaacata

SEQ ID NO: 2019 - DNA, 613 bp, Eucalyptus grandis
agaaagagagacagagatatgggaagagggaaagtagagctgaagaggatagagaacaaaatcaacaggcaagtaacatttgcgaagagaagaaatgggcttctcaagaaagcttatgagctctctgttctctgtgatgctgaggttgcgctcatcattttctccaaccgtggcaagctctatgaattctgcagcagttctagcatgatgaaaacaattgagaagtaccagaagtgcagctatggttcacttgagaccaactgctccatcaatgagatgcagaacagctaccaggattatttgaagctaaaaacaagagtggaggtcctccaacgatctcagagaaacctccttggggaagagttgggtcccctaaactcgaaggagctggagcaacttgagcaccagttggagaattctctgaagcaaattcggtctgcaaagacccaattcatgtttgatcaactggctcatcttcagcacaaggaacaaatgctggttgaagctaacagagaattaaggaagaagctggaagagagcaatacaagaatccctctccgccttggatgggaagctgaggatcacaataacatttcatacagccgccttcccc

SEQ ID NO: 2020 - DNA, 564 bp, Eucalyptus grandis
atccccttgccttgttcaactctctctttctccccctccttctactgcgaatatcatatccgaagctttggcttcgacgacgaggctcacggaaattagagaaccatgaggaagccttgctgcgacaagcgggacaccaacaagggggcgtggtccaagcaagaggaccagaagctcatcgattacattcaaaagcacggcgagggtagctggcgaactcttcctcaagccgccggtctgctccgttgcggcaagagttgccggctgagatggataaactatctgaggccggacctcaagagaggcaacttcgcagaggatgaggaagatctcatcatcaaacttcatgcactcctcggcaaccggtggtcgcttatagctggaaggttgccgggacgtacagataacgaagtcaagaactattggaattctcacctaaggaggaaactcctaaagatggggattgaccccaacaatcaccggttgaaccaaaatctccctcgctctcaaacccggatgcctcggcagcacttcctcatccagtatgaagaccacatgaccctg

SEQ ID NO: 2021 - DNA, 410 bp, Eucalyptus grandis
tggaagctctgcagcaatctctcgtggacacactttcttcgaccacactgagtcctactggttcaggcaacgtcgcagaatacatgggccaaatggctattgcgatgggaaagttggccactctcgaaaacttcgttcaccaggctgacctcttgagacagcagacgctccaacagatgcatcggatattaaccacccgccaagcagcccgcgctcttctcgtcatcaatgactacatctcacgtctccgagctctaagttcattatggttagctcgtcctaggactgaaaacatctgttctgctaaactcttctgatgtaatcgatagttttgattgaaattaacgtttctagtggggatccatttactgcgactgtagcgattcgggccacatttatataaaagctat

SEQ ID NO: 2022 - DNA, 328 bp, Eucalyptus grandis
cgacccgttgatgaagccctggcagatcccatgtccgatacaacccataatagcgtccgcagacctgtttgagtgctgatgtatcgattgctgttgcaaatgtggaactagcgctttggattttagtctctttacctctgtgtttgatgtgaatattgtccgatgtctctgatgttcttacttcatcttgttggcagtggtaaaatgtcagtttcgtgtctgttgactggattggctctcttttttgtacaagggggtgtcgtttttcaccctcattagcttgtgaaatttgcatgatgatgaatggttgtaacaaacctatattagc

SEQ ID NO: 2023 - DNA, 380 bp, Eucalyptus grandis
ccaacaagtcatatatcctcgacttgctcccagtggaacgccttccattacttaatcgctgctagcgctaaacccccctcactcttcaccagcaaaaacgccttttctcgcacacaaatgggtcgtcgtaaaattgaaatacagccaataacgcacgagcgaaaccgatctgtcacattcctcaagcgcaagaacgggctgttcaagaaagcgtatgagctcggtgtgctctgctctgtcgacgtcgctgttatcatctttgaggatcgcccagggcacagccccaagctctaccagtactcgtctcgcggtatccaggatattgtgcagaggcatcttcatcacgacggcgagactgataaccgtggccctggggactt

SEQ ID NO: 2024 - DNA, 322 bp, Eucalyptus grandis
cgagacagaaccttcttggtggggcttgagaagcttgggaagggtgattggagaggcatctctaggagctatgtgaccacaagaacaccggcccaggttgcaagtcatgctcagaaatatttcctccggcaagtgagcttcaacaagaaaaagcggcgctcgagcctctttgacatggtaaaaaatcagtgctcctataaactattaccatcatatcggctatcatcaattagtttgatggggtttgataaattcttattgtataaggttgatgtcaaaaccgcggcgggtgatcgtttaggcagtttgacggccaagccga

SEQ ID NO: 2025 - DNA, 387 bp, Eucalyptus grandis
gaaagaagggagtagagaaggaggtgacataaatttgccacagaggcaacggactttgggagagatgacattggaggagttcctagtgagagccggcgttgtgagggaggacacacaaatgatggcaaggcctggcgacaatggagttcatgaagaaatgtcacaattcactagtaatggtctcgccagtagtgcggctgctggaaacgatttcatattctctagtaagcctgctggttcatcgttagattttattggaactagacctactcagctacagcaacaaccacagccacagccgcttgaaccaccggctccgctttttccaaagccggaaactgtgtcatttgcaacctccgtgcatctaccaaatacagcttcatatag

SEQ ID NO: 2026 - DNA, 450 bp, Eucalyptus grandis
gcgaatgctcctctccggattgccatgaactccaacgcttcctccaacccccagtcgatggccacctccacgacgtcggcgaccacgccggcggcgggcggcgacggcggcaagaaggtcaggaagccctacacgatcaccaagtccagggagagctggaccgaggaggagcacgacaagttcctcgaggccctccagctgtttgaccgcgattggaagaaaattgaggattttgtgggctcaaagactgtcattcagatccgaagccatgcccagaaatacttcttgaaagtccaaaagaatggggcagttgcacatgttccacctcctcgtcctaaacgcaaagctgctcatccctaccctcaaaaggcatcgaaaaatgttttagtgccgctgcaagcatccatggcccagccttcttcaacaaatcctgcttttacaattacacct

SEQ ID NO: 2027 - DNA, 786 bp, Eucalyptus grandis
ccaaacatccatccgtccatcagctctaaactttaattgtaatcacatcgtcctttctcgacaccaactgggtcaaatgcttaaaaaaaggaaaaggaaaagagaaagatgacgtttccttccttcctctccaccaccgctctcttctatttatctcctctctctctttcttcctccatgagcggtgctcttcaggttggatgcaccacttcaactcaacctcaatacataaacgtcgtgttgggaaaaggataaaggcagggagaaggagatggggaggtcaccgtgttgcgagagcgagcacatgaacaaaggggcatggagcaaggaggaggacgagcgcctcatcgcctacatcaagcgccacggcgaaggctgctggcgatcccttccaaaagcagccggcctgctgcgctgcggcaagagctgtcgcttgaggtggatcaactacttgaggccagatttgaagcgtggtaacttctccgacgaagaagacgagctcattatcaccctccacagcctcctcggcaacaagtggtcgctgatagcggcacggttgccgggaaggacagacaacgagattaagaactactggaacacccacatcaagagaaagcttcacgcacgcgggatcgatccccaaacccaccgtcctcttcgactacaccagcactgctggtgctggtgctgctgccacttcacactatctgttctaacgctaacaacagcggcaacaaggccacgcctcactcgacgacttgtgaagaattatcatcatcatcaaca

SEQ ID NO: 2028 - DNA, 476 bp, Eucalyptus grandis
agaagcgctgagttcttggtcaaagtctagcagtttcgggttctccatcaatcgagtcggagtgggagaaaatgagcacaaatggtttgctgaagtttgaccaaagtctttagtgagatggttgctgtctcccgttctcctccaaacagatgtctgatcaaataacttacttgaccgccagtatgaactctcctttagcccagcttgttaacccaagaaggatgcacacctacgagccatttgaccagttccccatgtggggagacaccttcaaagctgacaaggtcaaaaatctcgaggcatcgtcatctgtgatcgtgcatgcagtagatgatggattggacaagaagtttgaatatgtttctcatgaatcggcagaaaattccagctccaggagcgatcaagaagcaaatagacctgacaaggtacagagacgtctagcacagaaccgtgaagctgctcgaaaaagccgtctg

SEQ ID NO: 2029 - DNA, 535 bp, Eucalyptus grandis
cagccggatgtaccttagtgtactgaatagcctaaagccatgttcctatcagatgttaacttgcatatggaaatgaatattacaacatgcgcgctttcttgagttttttttccctctgtagttgcacgcgaagaagcgctgagttcttggtcaaagtctagcagtttccgggtctccatcaatcgagtcggagtgggaggtatgaactctcctttagcccagcttgttaacccaagaaggatgcacacctacgagccatttgaccagttccccatgtggggagacaccttcaaagctgacaaggttaaaaatcttgaggcatcgtcatctgtgattgtgcatgcagtagatgatggattggacaagaagtttgaatatgtttctcatgaatcggcagaaaattccagctccaggagcgatcaagaagcaaatagacctgacaaggtacagagacgtctagcacagaaccgtgaagctgctcgaaaaagccgtctgcggaagaagaaatatgtacaacaactagaatcaagccgct

SEQ ID NO: 2030 - DNA, 723 bp, Eucalyptus grandis
gtgaggcgctgcctccaccaccaccgccgtccccaccgccgccgccgccaccaccaccaccaccaccaccaccaccttatactgtacaaataatcccttggcctcggccgttatagcctcttactcaaaaatcagtttttacccttttctgttgcgtagtcgtagttttgggccaggggttctattcggtatatgtagagaagtcagtgggcgaaaccgagcgtcgagcggtcggccatggcttcctcttcttctgtagcttccgcgaggaaggacgcggatcggatcaaggggccgtggagccccgaggaggacgaggcgctgcagaggctggtccagagctacggcccccgcaactggtccctgatcagcaagtccatcccggggcggtccggcaagtcgtgccggctccggtggtgcaaccagctctcgccccaggtggagcaccgccccttcaccccggaggaggacgaggccatcgtccgcgcccacgccaggttcggcaacaagtgggccaccatcgctcgcctcctcaacggccgcaccgacaacgccgtcaagaaccactggaactccaccctcaagcggaagtgctcctccacgtgctcggccggcggcgacgacgccgacgccctcgcggagcagcagccgctcaagcggtcggccagcctcgggacgcccacgggcggcaacaacgccgtctccgatctgttcttcagcccg

SEQ ID NO: 2031 - DNA, 412 bp, Eucalyptus grandis
gctctctctctctctctctctctctctctctctctctgtggtggctttcttctgtttttggctgtgatcagacaaacaaaaaccatctggttcggcgtctgaacaagaaaaaatttgagaagggattcaaggaagatggcgaaagagaagataaagataaagaagatagacaacttgacggcgaggcaggtgacattctcgaagaggagaagagggctgatcaagaaggccgaggagctctccgttctgtgtgatgctgacgtgtccctcatcgtcttctcagccactggcaagctctatgatttctccagctccaggcagatgaagggagaggatctggaggggttaaacgtggaggaattggaccaattagagaagaaactcgaggcgggactgagcctcgtgatcaaga

SEQ ID NO: 2032 - DNA, 495 bp, Eucalyptus grandis
gagttaccaccacccctttgttttattttcgatcctgcatctctcaaaatgaggaaacctgatgcctctgggaagaacagctccaacagcaacgctaacaagctgagaaaaggactctggtcgcctgaagaggacgacaagttgatgaactacatgctcaacaatggccaaggctgctggagcgatgtggcccggaacgccgggctgcagcggtgtggcaagagttgccgcctccggtggatcaactacttgcggcccgacctcaagaggggcgctttctccccacaagaggaggagctgatcatccacttgcattccatccttggcaacaggtggtcgcaaatcgcggctcggttgccgggacggactgacaacgaaataaagaacttttggaactcgaccataaagaagaggtcaagaactcgtcatcatcttcttgtagacactcggcaaacacgagcgattctccttgtcatcagacgttaaagatgtatg

SEQ ID NO: 2033 - DNA, 220 bp, Eucalyptus grandis
gcccccgagatcgcgccgccgctcgcggcccctcgcggcgggcaccaccggcgggcgcactccgaggtcaatttccggatcccggaggacctggatctggggccggatccgttcgagaacgggccctccgggagcttcgaggacttcggatcggaggatgatctactcagcacctacatggacatcgagaaattcggatcaagctcgacgcgggcagggg

SEQ ID NO: 2034 - DNA, 445 bp, Eucalyptus grandis
cttctgagaatgtgtccggtggagccatcgaacgtcccagagccacgggaaaattggctgcgcctgtaaactcgcccagcatgtcctcatcattggacctgaagaattcttgcatggatgcaaatgccaaccctgtgagcattttgcaacctggtgtagtgccacctgaagcctggttacaggtaatgtcactctgtggtaggttacttaaaatatttccctggaaggccagtacttctgttctttctgctgtttcttcaagttgctctctacaatatcatcgactttgtttctcaaaattcgctttgtgtaagaatgaaagagaactgaaaagggagaggaggaaacagtcgaaccgtgaatctgctagaagatcaagactgaggaagcaggctgagactgaagaacttggcaaaaaggtggattctctgagtgccgagaatag

SEQ ID NO: 2035 - DNA, 349 bp, Eucalyptus grandis
ttttttttttgtatataatctctttatttctagttagggaaaattcagaaagaagccgtgaaggaacttcatccaatggcgatggaaaatctgaagtgcaaggaaaggttgctggggaggtggatgctgcttctgagaatgtgtccggtggagccatcgaacgtcccagagccacaggaaaattggctgcgcctgtaaactcgcccagcatggcctcatcattggacctgaagaattcttgcatggatgcaaatgccaaccctgtgagcattttgcaacctggtgtagtgccacctgaagcctggttacagaatgaaagagaactgaaaagggagaggagggaacagtc

SEQ ID NO: 2036 - DNA, 648 bp, Eucalyptus grandis
gagagagagaaagccagagagagaaagaggaggattttggatgaacgtatattcattgggaggtgctagtcatggggaggcaaccgtgctgtgacaaatccggggtgaagaaaggaccgtggacggcggaggaggacaagaagctcatcaacttcatcctcaccaacggccactgctgctggcgtgccgtccctaagcttgccggcctccgccgctgcggcaagagctgccgcctccgctggaccaactacctccgccccgacctcaaacgcggcctcctcagtgaggctgaggagcagctcgtcatcgacctccatgcccgcctcggcaacaggtggtcgaagatcgcggcaaggttgcccgggagaaccgacaacgaaataaagaaccattggaacacccacatcaagaagaagctgctcaagatggggatcgatcccgtgacccacgagcccttgaacaagcctcagaaaactccatccgaacacgacccggaagcttctctgtcgtcatcgcaagcggaccctacgtccgaatcgcccgccaacacgcaccaacccaacaacgcccacgcggacgaagtacaactcgtcctcgtcctccccgtcggcctgtccgccgagaactgttgctccggcagggacgagt

SEQ ID NO: 2037 - DNA, 268 bp, Pinus radiata
ctgagcagaaatatggatgacgtatttgttcagcgctgcaacagaaactttacagctcgagatcggctaatctctaaagagagaaggaatttcgggtgggtttgtggcgttactgaagaggaagaagaacttattatcagaatgtataagctcgtgggcaacaggtggtcattgattgctgggcgccttcctggtcgaaaagctgaagagattgagagatattggaagatgagaagcataaatgctgcacctctgaagcctaatacct

SEQ ID NO: 2038 - DNA, 1055 bp, Pinus radiata
ggcgaatcgagctccagtctctgcccttaggcacacgtacaacatacgtggctaacagagataacacccaaagcctatccagccatggtcgatggatggttggacagtgatacaggcaggagagggttcagctggaccacagttttggatagaatggttgcttttgcctcctcggctcttactaatcttctgactttggcagtatgtcttccgtgatatatttaatgtgtatacgttcttttggggattgcgagacagcagatccaagtctgggctgtggatctggaacgcattttaagctctggtctcttcaattgggtttctggtagcgagctccatcacaatggtcaaagaattgttgatgatgtgttccaactgtgggcacagtgggcacagctccagagcctgtcctgatagaggatctgtcaaattgtttggggtcaggctcattgctacagacgatggcatggcctgcatgagaaagagcctcagtatgggcaatctcggtcattaccgttcactttacaatgtcaatcactgttctgggacaagcgaatgtggatctgcagatcaggatgggtatttgtctgatggatttgttcattcttccagcaatgcacgcgagaggaaaaaaggcgtcccatggtcggaggaagagcacaggatgttcttgtatggactggaaaagcttgggaagggtgactggagagggatatccaggaattttgtgacgaccagaacacccacacaagtagccagccatgcccagaagtattttctaaggcagagcaatcttaataaaaggaaacgtcgatccagtctctttgatatgtgtcctcatgattcccatgtcacaagctcttttcgcagagaagactcattgggaaacctttatgaattttcgccaaaacattcggctttgggggtatcgcctaatttcgaactatattcatttggtgtttctccaactttatctctaggaagatccctgcaaccagtggaagcagttcttgaagagaaagcagcccattatcatcctgtgaactcagaagaag

SEQ ID NO: 2039 - DNA, 167 bp, Pinus radiata
tggttacagctctgtagcggaatagatgaacatgcagctggattctgttctcaacttgtgtttgcaccaattgatgcatcttttgctgatgatgctcctctggctccctctggtttccgagtaattcctctagaatcgggatcagaatgtttctcctccaaaacgga

SEQ ID NO: 2040 - DNA, 357 bp, Pinus radiata; identical to SEQ ID NO: 360

SEQ ID NO: 2041 - DNA, 438 bp, Pinus radiata
ccgaagcaagatcagaaactcgttacttacatacaggagcatggccatggcagctggagggctctgccgcagaaagctgggttgctgagatgcgggaaaagctgcagattgcgttgggctaactatctaaggccagatatcaagcgggggaagttcactgtgcaggaagagcagactattattcaacttcatgcactacttggaaacaggtggtccgccattgctactcaccttcccaagcgaaccgacaacgaaatcaaaaactactggaatacccacctgaagaagcgcttgctgcagatgggaatcgaccccgtgacgcacaagcccaagtccgaatcgattatggtacctggtgttcagtcgtccaatgggtcctcgaatctgagccatatggcgcagtgggagagcgcgcgcctggaagccgaatcgaaggct

SEQ ID NO: 2042 - DNA, 319 bp, Pinus radiata
ggaattttcattggaggaagttgtgttggtggggatcaaagtcattcaatgagtggaaatggagccctagcatttgatatggagtatgctcgttggttggatgagcatcatcgacagataaatgaactgaggtcagcagtgaactcacatgtgggggacaatgagctgcgtggtctggttgaaggtgtcatgggacattacgatgaaatttttcgtctgaagactgtagcttcaaaagctgatgtctttcatctggtctctggcatgtggaagacgcctgcagaaagatgcttcatgtggatgggaggattccgtcctt

SEQ ID NO: 2043 - DNA, 404 bp, Pinus radiata
aaccggagagcaagaacaaagtggaaacgcaacgaagtggagtgcgataatctgaaacggtgttgcgagagtctgagggaggagaacagaagattggagaaagaagtgcagtcgctgagagccatgaaagtcccgcagtcacccaattcgatgcctctggcagccgccaccctcgcaatgtgtccggcctgcgagggccttgcaatcaagaaccgcggcgccgccacttcctccaccgcgaagtcacaacaatccctccttacaattatggggattggggatgtaaatatgatatccaaaaataaccaaaccccttcaatgggaatgggagatgaaatgaattgaagaaagtgaacttaaaaaaaaaaaaaaaaaaactcgagactagttctctctctctcttc

SEQ ID NO: 2044 - DNA, 379 bp, Pinus radiata
ctggaacctgatagaagagaagattgaaggaagatcaggaaagagctgcaggcttcggtggtttaatcagttggacccaagaatcaaccgaaggcctttcactgaagaagatgaggagaagctactggcagcccatcgtttatatgggaataaatgggccatgattgctcgcttatttcctgggagaactgataacgctgtgaagaaccactggcatgttatcatggccaggagatacagagagcaatccagtgcttttgggagaaggaaattgcctcaagttcatagaagagagaaacgtgcctgcactgatgatgaaacgaggatgggcagcagcagctgcaacatgtgggtggataaatatagctctctcaaatct

SEQ ID NO: 2045 - DNA, 369 bp, Pinus radiata
ctcattgcttacattcgagccaacggcgaaggcagctggcgttcccttcccaaggctgcagggctgccgagatgcggaaagagctgtaggctaagatggataaactacctgcgtcccgatctcaagcgtggaagcttcacagaagaagaagacgaactcatcatcaaactccactccgtcgtcggcaacaagtggtctcttattgcaggaagattgccggggcggacggacaacgagataaagaactactggaacactcacatcaagagaaaattgctgatcaagggaatcgacccccagtcccatcgtcctctcgggcagccctacagcagcaacaatatgcccgtctctcggctatttctgacctcg

SEQ ID NO: 2046 - DNA, 530 bp, Pinus radiata; identical to SEQ ID NO: 335

SEQ ID NO: 2047 - DNA, 358 bp, Pinus radiata
gctctaccagtgtcaagccttgtttgaaaatggcgcagtcgaaaaactctcaagaacctataatgatctatatgatgatttaaaagaagaaatactgtcgtggctgccagtggaatgtgtgtgcagatttcgcagcgtctcaaagcagtggaataatctcctgtcatcacacaatttcataaaaaaggtatggagaaagaagcctgctaacatgaacccatggctcgttctgcatcctgtcaactcctcctattgtttggcatactgcttcttcacaagaacctggaagactacctcctctatctccattgaaaatgccaataattatggagaaaacggaatcttggggatcagctgc

SEQ ID NO: 2048 - DNA, 376 bp, Pinus radiata
aagacaagaagctcattaatttcctgactactcatggccaatgctgctggcgcaccgttccagagcttgccgggatttcaagatgcggaaagagttgcaggctgagatggacgaattatcttcgccccgatttgaaacgaggagtcttctcagagtccgaggagaaacttattttagatcttcattcgcgtgttggtaacagatggtcgaagattgcctcgtttctgcctgggcgaaccgataacgagctaaagaactactggaacacccacatcaagaagaagctgaagcgcatgggactcgaccccggcgacgcacaggctatttcagaaacactaccacagccagcccctgtagctgagaataatgatgtccc

SEQ ID NO: 2049 - DNA, 656 bp, Pinus radiata
caaacaatcatcacgagatgaaattcccttcagaatgggatttctgagattcgatccttgatctgttgctgcgatctgatcacattttattgggggtttagggtttaagttttctctgctaatggcatcgatgaaaggaaaatctccgggtcacgatgagcccgatcggatcaaggggccttggagccccgaggaggacgcagcgctgcagcatttcgttcagaaatacgggccacgcaactggtcactgatcagcaaagcgattcccggccgatctggcaagtcctgcaggcttcgatggtgcaaccagctgagcccccaagtcgagcaccgccccttcactcctgaagaggacgccactatcgtgagagcccacgcccagcacggcaacaaatgggccacgattgcgcgcatgctcagcggcagaaccgacaacgctatcaagaaccactggaactccactctcaggaggcgttgccaaggtgggggcgccctcgtcatcgacgacgagatctccagcggcgccgacgggtttcgaaaacggaacctcagcgaagacgccgatgccagccggaaattcaagaagctcagcctcgggacgacgacaacgaccacgaccacggagcctagcacctcctcggcctcggatcggagcg

SEQ ID NO: 2050 - DNA, 466 bp, Pinus radiata
atggggaagacgaagatggagatgaaacacattcaaaaccctagccgccgccaagttactttctcgaaacgcaagaacggattgctaaaaaaggcattcgagctttctgttctctgcgatgctgaagtcgcccttatcattttctcggaaactggcaagatcagcgagtttgcaagccacaacgacatggcaacaatactggaaaaatatcgcatatacacgcaaacagaaacagatggaaacatgggggcttcgtcggtccaaagcgtgaagggatggtttcctaattttctcgagattgcgggattcagtgtttgtggatgatccctattattgcagtgtgggttggggcacgaggggtgcagttgactcgactcatatgattggaaggttggtgaatcacaattgaaagcgttgcacgagaggatggacaatttgaaaaaacaggaacgaaacatggttggtg

SEQ ID NO: 2051 - DNA, 390 bp, Pinus radiata
gtttgaagtagaatttacctatcaattgcgttaaagatactctgttttcggccctgaaccctaccaggggaacgcggcgccatgtcttcgaggagctgttcgttgtgcggccttaatggccacaattcccgtacctgtgtgggaagtggtgtgatgctctttggggttcgtctgacggatggaccaatgagaaagagtgctagtatgaataatttgtcaaacttatctcaatatgagcactcggatccggctgaggttgccgctgaaggttttgatggttacgtctcggatgacctcgttcattcatccagcaatgcccgtgagaggaagaggggagtgccctggacagaggaagaacaccggatgtttcttgtcggccttcagagagtc

SEQ ID NO: 2052 - DNA, 312 bp, Pinus radiata
gtttgaaggggaacgcggcgccatgtcttcgaggagctgttcgttgtgcggccttaatggccacaattcccgtacctgtgtgggaagtggtgtgatgctctttggggttcgtctgacggatggaccaatgagaaagagtgctagtatgaataatttgtcaaacttatctcaatatgagcactcggatccggctgaggttgccgctgaaggttttgatggttacgtctcggatgacctcgttcattcatccagcaatgcccgtgagaggaagaggggagtgccctggacagaggaagaacaccggatgtttct

SEQ ID NO: 2053 - DNA, 393 bp, Pinus radiata
cgaggtcgagtccagctgaggaggatcgaaaacaaaatcagtcgtcaagtaactttttctaagagacggaacggactgatgaaaaaggcggcggagctgtcaatactgtgcgacgctgaagtggccttaatcgtcttctccaacaaagacaaactgtacgagttcgccagttccagtatgaccaagattttggaaagatatcggaagcgttcaaatttaatacaagatatcggtaaagatccacagaattcagacattgagttgacgcgtctaaaagaagaggttgaccgcttacaaagatccagaaggcatcttttgggtgaagaccttcatcaactaggtgctacggatctgcaacacttagaacaacagcttgaagaagcgttacaaaag

SEQ ID NO: 2054 - DNA, 210 bp, Pinus radiata
cacagttctggaacctgttaaagagaaatcagtcgaggtcaaactccttctgtttgcacgaggatgcccagcattatggagaagcaaaatagtggtgaagatagtgatagcaagggtcagcttgataatggcaagtatgtccgttacaccaatgagcaggtggagactttagaacgtgcttataatgaatgctcaaagcccagcacaagg

SEQ ID NO: 2055 - DNA, 385 bp, Pinus radiata; identical to SEQ ID NO: 389

SEQ ID NO: 2056 - DNA, 545 bp, Pinus radiata
tgaagaccttgatgattgtatccatccaccggagaagaagagaaggctgactgctgaccaagtgcagttcctggaacgaagctttgagatcgaaaacaagttggaacctgagcgcaagatacagctagccaaggagttgggcctccaacctaggcaagttgcagtctggtttcaaaaccggcgggcaaggtggaaaacaaagcagttggaaagggattatgatattctgaaatcacgctatgagaatttgagagttgattatgatagcctgctcaaagaaaaggataaattaagggctgaggttaccttcctaacagacaagctacacgacagtgaccatgaagccctcacaaaggattctgagtctgctgacaagaaagtctatccccagcctgcctcccactctgactgtgttggggagcctgaaagaagtactgctgccaaggatacaccaccaggttgtaaacacgaagatcttctgagctctggaacagatagcagtggggtcctggatgaagatagtcctcaccatgttgactgtggtc

SEQ ID NO: 2057 - DNA, 385 bp, Pinus radiata
aaacttgctcacggattccgacccttccggctaaagctgctgcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcgtcatcaaactccactccctactcggcaacaagtggtctcttattgcaggcagattgcccgggcggacggacaacgagataaagaactactg

SEQ ID NO: 2058 - DNA, 436 bp, Pinus radiata
aaagaagggtgttccctggactgaagaagagcacaggcagtttttgatgggccttcgcaagtacggcaaaggcgactggagaagtatttctagaaactttgttgtgtcaaggacaccaacccaagttgccagccatgctcaaaagtactacattcggcttggttcggataataaaaacaagagaagatccagcatacatgatatcaccactgttcatggtacagacaggatgccttctcctttactgcacgtttctaataggcagactaattccccctcaacacaggcagaaatgaatcattcaccatgtctggacatatccatctcagatttcacgaggacctctaataaactctttgggacctcaaatagatggtaaccttctattttcacctcactatcctctaaatctgtatacccagagagggtttggggg

SEQ ID NO: 2059 - DNA, 624 bp, Pinus radiata
tttttattcaaatgacagcacgacttcccttcctcagatgtttcccaggctgcactcatcagctgcagcaccacgcggttttggattctccctgttctttgttctgttgcgttaaagattggttgcaggtcgaatcgcccaggccgatttgaattctcctgaggattgacaagatgacgcgcaagtgctcgcactgtggcaacaacgggcataactccaggacgtgccctaaccgcggcggggtgaagctcttcggcgttcggcttaccgatggcccgatcagaaagagcgctagtatggggaatttgatgatgatgtccaaccctagctctcccgctgacccctccgagccggcctctgccgctgctgctgccgcggcggcggcggccagtggctatctctctgatggtcttgttgaagcctccacttcctccaattctcgcgagcggaagaaaggtgtgccatggacagaggaggaacatagaatgtttttgctaggtttgcagaagcttggcaaaggtgattggagaggaatagcacggaattttgtcataacacgaacacctacacaggtagccagccatgcacagaaatattttattcgacagagcaatatgactagaa

SEQ ID NO: 2060 - DNA, 364 bp, Pinus radiata
atcgaggaaaaccagaatcttctcattttcacttgctgtgggtttctctggactaacgatgaagatgtctctaccttctaatgttctcactctcagtgcggattccaattctaattccaattcgatctcctcgtcaggagacgaactcgccgcaaaggtgaggaagccatacacaatcacaaagcagagagagaggtggagtgaagatgagcatcttaagtttctggaagccctgaaaatgtatggccgagcatggaggcgaatcgaagagcacataggcacgaaaacagctgtccagatacgaagccatgctcagaagttcttctccaagttggtaaggggatcttcaaataaaggtgtgtct

SEQ ID NO: 2061 - DNA, 258 bp, Pinus radiata
gagggatagacatgaatcggggtccggctaccaatgagtctgagtattcgtcggttttccaggccgatgccttgcggacgattgacactggttccgtggtagtgaagcgagagcgagaaagaacctttgagttggaggcggagagggatcgaacctgcgacgtgagttccaggacaagcgacgaggaggagataggttcgacgaggaaaaagcttcggctttccaaggagcagtctgcactcctggaggaaagtttct

SEQ ID NO: 2062 - DNA, 347 bp, Pinus radiata
aacttggagtcactcacgttgaaagaattgcaacaactggaaaagcaattaggcagggctataaaaaagatttataataaaaagatgaaaataatttcacaatgttgcaaatcattatcagaaaaggtacgctctttggaagaggagaatagtgaacttcttaccaagttgattcctagagccgattcctccacttctggggctgcgttatttgttgatacatccatgccaaaatctcactcagcaaccgaagcatggcgacaactcctccagcgagtccttgtgacagcagcgaagatggcgacaactcctccagcgaggcacagtaattcccgaccgaaccacta

SEQ ID NO: 2063 - DNA, 267 bp, Pinus radiata
tggcaaggcaacatcgggatctgcaaatgaggccatgtcacaaagtggggacagtggcagtgacggttcaagcgaaggaagcgaggaatataacactcaaactgagtcacaagtggcgagaaagagaagttttgatcaaatgatagtagatggagccaatgctcagagtaccaatattcaatcatataattcccaggctggagaaccctatgtgacttccggcgggcatgcaatgggtaatcccattagtcaagctgttgctgcagt

SEQ ID NO: 2064 - DNA, 336 bp, Pinus radiata
tcaacttaaatggaaggaacggatcttaaccgaagagaacctttttcttcgtaaaaagtgtggtgatgaacatgtggattgttcggcttttagaacacctccagcacaacttagaagcatccagaacattgatgtggagactcaactggttataagacctccaactgtacaacagcaccctgacgtcgatagtcctcgataactgttgcatatgcaaattttctactttcatgaaataaacaaacagtacacctcattttgttcgccttttgtaaacgtataattactactgcatatgtaagctttcctctcaaaaaaaaaaaaaaaaaaaaaaac

SEQ ID NO: 2065 - DNA, 573 bp, Pinus radiata
cgcagatcgggactgcaaacagaaccatagttctgcaacattcaatgggacggactccttgttgtctgaaagtgggactcaatcgaggtccctggacacccgaggaggatctttgcctctcaaattacatcgaagctcacggagaaggcgggtggagaacacttccaaagaaagcaggtctgctccgatgcgggaagagttgcagattgcgttggatgaattatctccgacccgatgtgaaacacgggcacatattacccgaggaggaagatttaatactcaggttgcatcgtcttcttggaaacaggtggtctttgatcgctggacgtatgcccggcagaacggataatgaggtcaagaactattggaatacccacctcagcaaaaagcttatcagtcagggtatcgacccgcggacgcacaaaccgttgtcagaatccgaagacatatgttcgagtcccgggaatagcgaagtgagccgcaagtctcaacgggaaaataacgctgaaataccaagaaaagttgccgatggcgcagttgatattcaagataaggaagaggatatcacagaag

SEQ ID NO: 2066 - DNA, 407 bp, Pinus radiata; identical to SEQ ID NO: 333

SEQ ID NO: 2067 - DNA, 407 bp, Pinus radiata
atgctttgtggccggttcaaatatttgagctggcttagcttctctggttcagaaatggcggactaaagtaatagtgtgccccgaggtctggtgttcgaatctcgttggcgtgaaaggtcaaatttttctctcgagtttcattgattctgaaaaactggcatagctatggcgatgagcaatgggagattgtgtgaagatttggataggattaaggggccgtggagccccgaggaggacgcgtcgctgcagaggcttgttcagaaatacgggccgaggaactggaccctgataagtaaaggaatcccggggcgatccgggaaatcgtgcaggctacggtggtgcaatcagctgagccctcaggtggagcacagaccttttaccccgtccgaggatgctgctattctgca

SEQ ID NO: 2068 - DNA, 353 bp, Pinus radiata
attttttctgtagatggtgtgaggacgtgctgaatagttcctaaatcgtttcttccgcgtttggtcatcgaacgagttcctataactcgccaagaccaggttcttcacggactactaattttgggcttctacacatctttcccggaagtagatggggcgggcactaggaagaacagaaataaagaggatagaaaatgaagtgagcaggaatgtgagttttagaaagagacgacgtggattgctgaagaaggctgcggagttgtcaatactttgcgatgcaacagtgggcgttgttgttttctctccggccgggaaactttctgaatatgccagcacttcggagcaaatggata

SEQ ID NO: 2069 - DNA, 393 bp, Pinus radiata
attcgaaaccctaccaatcggcactcatccttctacaaacgcaagggcggtttgcttaaaaaagcatttgaacttgctgttctctgtgatgctgaagttgctctgataatcttctctgaaaccggcaggatttacgagtttgcaagccacgatgatgtgaccacagtattggcaaaataccgaatacaaacgaaaactgccggaaacgcaatgccttcatcgcttcaaaaaacagagtttgatcaattacaagtcaggatgttgcaggagaagatagacaatttggagaaaacgaaaaagcatatggtcggtgacaatttggagtcactgacgtggaaggaattgcaacaagtcgaaaagaaattaagcaaggctacaaaaataattgtggcc

SEQ ID NO: 2070 - DNA, 461 bp, Pinus radiata
cagcctgtggctcctgaaagcatcgtccctcctcatcagccgccgcacaaccaaacgccgaaccaatacatgcaaggatggtgggtttgatatttaacatttatcattatcagttacttcaatcacaacaaaagcccaaagcgtggtaaattacgaaattagaattatattatcattaaaaaaaaaccctattttcattgtatagcagtaggcttgatttactgctatgatagcggaggttttattgggcaaacaaaccctactggtatattagaccttcttgtcgacaaagtttaattgcataaatcttgtatgctaatctggccgctaaaagagcgatggaaaaatagttgtcccattcacaacacatgatatgtttaaatccaacgtgtatgtgtctgcaaaatattattatacactacggtttatcacatggtagtcgattcgccataaaaaaaaaa

SEQ ID NO: 2071 - DNA, 373 bp, Pinus radiata; identical to SEQ ID NO: 1982

SEQ ID NO: 2072 - DNA, 506 bp, Pinus radiata
ggactgcagaggaagacagaaaactggtgaattttatcaccctgcatggccatggatgctggcgcgaagtacccaaacttgctggtctgcttagatgtggcaagagttgtagattgcgttggacaaattacttgcgcccagatttgaagcgtggattattgtctgaatcagaggagaagctcatcattgatctacatgctgccatagggaataggtggtcacgaatcgctgcgcaattgccagggagaactgataacgagatcaagaattactggaacacgaggatcaagaagaaactgcgccagatgggaatcgatcctgtgactcacaagcctctcacccaaatgcaaatgcagagcacccctgcccagactctgctgctgcaagaaaatgatacagagcagcagcagcaggagcaacataatgagcctgatcctgatcagaatcagagcagcaatggcactgtggagacattggtctcgagggccagagaaccccacgaccac

SEQ ID NO: 2073 - DNA, 494 bp, Pinus radiata
attcagatggaacaacaacaatgtctacatatgaaagaaaagccagtcttcgagaattctatgctgttatatatccttccttgctgcaacttgaaggaggtataacagagatggaagataataagcagaaactgatttgcaaagaaagatacaagaaacgtgttgatgaagaaaggagacatctttctgagcttgatctggaacgtgaaaaagagtgtggaatatgtatggagactcagaccaaagttgtattgcctaactgcagtcatgcaatgtgtttgaattgctatcgggaatggcatgcacgatcagaatcatgccctttctgcagggatagcttgaaaagagtgaactcaacagacttgtggatttttacaagtaatgaagaagttgttgacatggaaacattgggcagagagaacttaaaaaggctatttaattacattgataaattgccacttatagtgccagagagcctgttttatgtttatgat

SEQ ID NO: 2074 - DNA, 1678 bp, Eucalyptus grandis
ctttttcttccctgtcctgtttctctgtgctcacatcttttaatatcacaccgaggctggaattctgccaggagccgcctctggtgctggctgacatttcacctagaagtcacaaaaactttgtagttaccattttcggaaagattttgaggaaacacgcgcagagggagagagagagagtggaagagagagaatctagtctctggatggggaggcattcttgctgttacaagcagaagctcagaaaaggcttatggtcacctgaagaggatgagaagcttctgaggcatatctctcagtatggccatggttgttggagctctgtcccaaagcaagccggtctacagagatgcggcaagagctgcagattgaggtggattaattacttgaggcccgatttgaaaagaggggcgttctcgcaagatgaagaggacctcattattgagctccacgctgctcttgggaacaagtggtcgcagattgcagcaaacttgcctggcagaactgacaatgagataaagaacctgtggaattcttgcctgaagaaaaagctcaggcagagaggcattgaccctgtgagccacaggcctctctctgaggttgagaatagtgacgacaaggacgcaacgtcagggcagacccaagataaggtctctcgtgggtcagttgaattgctgagccagctcaatccacaattctcaagctccacgacagcaaggagcagtaaaaacagcaatttgatggcaccaacattgagcaaggacacagttgcagatgggtttgtgagcaatcaccaagagaactcgatgatgaacagttgcatctcagactttgttgataatttctctctgcaacaattgaactactcatcaagtgattccagattttctaatctctgtttcacccaaacgggcagagcacatggaaacaccatcttttccgacttcaattcgaatgtaatatctgccatttctcctccctcatctaactctttattccctactgcttcaatgggcttcaacttcaagccatctaatgctgtcccctcggcgaattcgacttcaagcgctagcacaggaactgcagattttcacaacagtggctcctacttcgggaacagcttagtttcctggggattgttagcagattgtggctcgccagacaaggaggggtcgacttcgatccatccattggaagttcaccaacccggagacttcaagtgggctgccgaatatctccagaaccctctgttcatggcggccgcgctgcagaaccaagcccaggaacagtccaatttgtacaatcagataaagccagagacccagtttcctccagaccattcaactacttccatgtgggatcatctacagggacatgaatccttggacaattctttgaatacgtgcggcaaggatatccagagattaacggcgctactcggacacaattagatagaggattatattagctgatggagcctcagctgttgaagcaggaggggatcatttgattggtggcgacttgagaatttgcagattgttatttgttacaggtgtggactataattttttttttttaccccttttcctctttcaatgtacatagttctgatacaaaacatctgcatccccttgccttttacctatatttgctttaagaaaaaaaaaaaaaaaaaaaa

SEQ ID NO: 2075 - DNA, 636 bp, Eucalyptus grandis
aaacagagagagagagagatcatgagatacccagctccagctccagcttcaaggggcaagagcacgagcacggcaacgccatgctgcagcaaggtggggataaagagaggcccgtggacgccggaggaagacgaggtcctcgccagctacgtgaggagggaaggcgaggggcggtggcggaccctcccgaagcgtgctggcctccagcgctgcggcaagagctgccgcctccgctggatgaactacctccgcccctccgtcaagagaggccagatcgctcccgatgaggaggacctcatcctccgcctccaccgcctccttggaaacaggtggtctttgatagctggaagaatcccgggccgcaccgacaacgagatcaagaactactggaacacccacctcagcaaaaagctcatcagccaaggaattgatccccggactcacaagccattattgaaccataaccctagttcttcactagcagcccatttgcaagatacttataatgcttcaacattcacaccgaaagcaacttaccctaatcctacagtaccagtggaagaaaccggcgacgaaaatgatctgaaagtgggcagacagccagctgggtcagcctcaaaacgcgggcgttgccaa

SEQ ID NO: 2076 - DNA, 862 bp, Eucalyptus grandis
caaacgtctccgtttctctccaagctgaacatggacaagaagccagacgacgacagtggtaagtcccaagatgtcgaggtgagaaaagggccgtggacgatggaagaggatctcatcctcatcaactacatagcgaatcacggcgaaggcagttggaactccctagccaaagctgctggtctaaaacgtaccgggaagagttgtcggctccggtggctgaactatctgcgacccgacgtccggagaggcaacatcactactgaggagcagctcctgatcatggaactgcatgccaagtggggaaacaggtggtctaaaattgcaaagcatcttcccggaaggactgacaatgagataaagaacttctggaggactagaatccaaaagcacatcaagcaagcagaggctttctctggtcagagctccgagatgagtgatcaagcaagcacaagccacatgtccagcatgccagagccgatggagacctacgactcaccgccgtcattccaaggcaacaacaacatggagcctttgccggtgaatttgtcggtcgagtcaaatgaagcctactggagcatggacgatctttggtctatgcagttactcaatggggattgatcgcggggtgacgtatggtgcagtaatcgaaatggttcgtttacaataatagctaggtttgtttacataaaatggacattagcttttatctcacatatatatctacatacatgtgctagtttagaagttatctacaaatatgtgcatgagttgtaaacgaaactaccatctgcagtttgcatccccgctatgtaatgactgaaataatgaagcgagattatttggcttaaaaaaaaaaaaaaaa

SEQ ID NO: 2077 - DNA, 907 bp, Eucalyptus grandis
gagatggacaagaaaccgtgctaccgcacgcaggatcctcaagtgagaaaaggaccatggactcttgaagaggatctgattctgatggactacatagccaaccatggcgaaggtgtatggaactctctagctaaagctgctggtcttcaacgcaccggaaagagctgccggctgcgatggttgaattacctccgacccgatgtccggagaggtaatatcactcccgaagaacagctcttgatcatacacctgcaatccatgtggggaaacaggtggtccgaaatcgcgaagcatttgccggggaggaccgacaatgaaataaagaactactggaggaccaagatccaaaagcacataatcaagcaatcggaaactgagatcaacgatctcactattcctccatcatccgcaaacgcatgcacagatcatcgcggggtctcggccgcaaatacaatcgagatcgcctgttctccaccgtcggatcaaggcggctccggcgagactatgctctcggcccttcctcctgcccaagaaccgaacgacagcgcttgctggagcgtggaggatctctggcccatacagtcactaattagcggcatgggtgatgatgcccaatactattccgtttaggccttaattagattatagatcatgacctgatgaacaaaacaaaagcaattagaagacccaaagggctcatttattgggtctttatgttgaagctagctaggtagatcttgtatgtatagagaaaaggccacagcatatcatatttcctatgtgatgtgctgtatacactaccatagctttgtgctaggtatattagctagcttgtagcagtggcaacatatctatcgaaataagaacttagataatacagcttttggttaaaaaaaaaaaaaaaaaa

SEQ ID NO: 2078 - DNA, 658 bp, Eucalyptus grandis
gggagacgtctccagctcgagtcgtcatctgggtccgcgtcttctcttcccttcttccaatggtttgatcctaggacagagagagaaagagagagatataccgaaagagaggtacagagagatagagggagagggagagggagactcgtggcgctgtttcgagctttctagcttccggaggaggagggctggtgttgagcgaaacttggagaggtcatgaattcgacaaccactcagtttgtgtcctctagaaggatggggatgtatgacccgattcaccaaattggaatgtgggacgagaacttcaagcagaatggaaatcctaatgcgccgccagctctgatcatacctatgcacgcgaatttggacaaccagtcggaggatacttctcatggatcacaggatactgctggcaagtatgagcaagaaacatcgaaaccttatgataaggtgcaaagacgtcttgcccaaaaccgtgaggctgcgcgcaaaagccgtctgcggaaaaaggcttatgttcagcagctagaagcaagtcgtttgaagcttatgcagttagaacaagaggttgaccgagctaggcaacagggtgtgtacatggcttcaggagtagattcagcttatccaggatatggtggatgtttaaattcaggaatcg

SEQ ID NO: 2079 - DNA, 373 bp, Eucalyptus grandis
gctcacttgggtcgcctctcgttctctcgtttctcgcctccttcttcgaagcagcagccagcacagtcgcgcaacgtgaagaagataaaaagaagagtgtggtcctgacgggaggggggcgtctctctagaaagactacgttttttcctttcgttaagaaatgagacaggggtctttctagcttctgggtcttgaggaggagggccattttcttcttgccgattcgataggttggcagcccgggatgatggcggtgacttcggcctgtaaggacaagatggggatcgacaacgggaagtatgtgcggtacacgcccgagcaggtcgaagctctcgagaggctgtatcacgagtgcccgaagccgagttcactg

SEQ ID NO: 2080 - DNA, 421 bp, Pinus radiata
gttccagaccttttgcatcttcattattcttccgcctgtgaaaagatggggagatctccgtgctgtgagaaggctcatactaacaaaggggcctggactaaacaagaagacgaccgccttatcgctcacattcgagcccacggcgaagggggctggcgttcgcttcccaaggccgcaggttgcttgcctgcgctctgctttcttaactgaattaatggctgcctgtaaattttccgtttaaatataatgtttcttgatgtccgatataacgtttcttgattttccgatataatgtttcttgattttccgatataatgattttcgattttccgtttatatataatgtttcttgattttccgattgcagggctgctgagatgcggcaagagctgcagactgcgatggataaactacctgcgtc

SEQ ID NO: 2081 - DNA, 746 bp, Pinus radiata
gtttaattcgacgacacctttgcctgttagaaaggcgcgggaggcttatcggaagccacaccaaaccaaatcagaaataatgggtagggctccctgctgcgaaaaggttgggctcaaaaagggcccctggacgcccgaagaagatcagaaactcgttacttacatacaggagcatggccatggcagctggagggctctgccgcagaaagctggtgattatgaatttatatttagttctagaacttgcaagaaattctctgtatttttgttttttgggtagttttcatgggttgagttttatgcagggttgctgagatgcgggaaaagctgcagattgcgttgggctaactatctaaggccagatatcaagcgggggaagttcactgtgcaggaagagcagactattattcaacttcatgcactacttggaaacaggtggtccgccattgctactcaccttcccaagcgaaccgacaacgaaatcaaaaactactggaatacccacctgaagaagcgcttgctgcagatgggaatcgaccccgtgacgcacaagcccaagtccgaatcgattatggtacctggtgttcagtcgtccaatgggtcctcgaatctgagccatatggcgcagtgggagagcgcgcgcctggaagccgaatcgaggctggcgcgcgagtccaagctcagggcaaggggcctctggtctgcccagttgagaaacgttaatgcgagctcggatttattcagcc

SEQ ID NO: 2082 - DNA, 244 bp, Pinus radiata
gaagatatcaagcaaatagttacacaccaagaaaatccacaatgggtagatctccttgctgcgcaaaggaagggctcaaccgcggggcctggacgaaaacggaggatattattctctccgaatacattcgaattcatggcgatggtgggtggagaagtctccccaaaaaagcagggcttaagcggtgtggaaagagttgtagattacgttggttaaactatcttcgtcccgacattaaacgcgg

SEQ ID NO: 2083 - DNA, 1151 bp, Pinus radiata
cttcaacaggtttttgttctgaaatcctgttatcacttcgctccatcttccatttttgttttctgacaaccttttaaacatgggaagggcgccttgctgctctaacgatgacagaaacaaaggagcctggaccaaagaagaggatgacaggcttatccaatatattaaggttcatggagagggttgctggcgctctctccccaaggccgcaggtctgcttcggtgtggcaaaagttgcagactgagatggataaattatcttcgccctgatctcaaacgagggtttttctccgaagacgaagatgatcttattctcaaactgcacgccctccttggaaataacaggtggtctttgatagctggccgtttgccaggacgaacagataacgagataaagaactactggaactcgcatctgaagcgaaaacttatcagcatgggaatagaccccctaacccatcgtccttttcaaaagacttctcaccatcatccctctcctccacagaatgttagagaggctgaaacaacaccttccattgggattgttcaagatttctttcgttgcccgtctgaacttagcaccaaatccgagcaaatttcagatgctgcaagcggactcgcgcaggatgagcaaccccacccgaacctgaacctgaacctggagctctcaatagctcgctcctcagtccatcgagtagcagagaaggaggacgttgttaattcccagcaaggcgaaagcaatctgagtgagggaaagtgatatttatgtcattatggagactgccctccccctccaatgcaacaatgagatgatataaatgtccctttcccgctcaccaaagccctacggggcaataacgaatacatgaaaaccgtttggctcatagcaagtctagttttcaacacttactattatttaaggaacgtaaaaagtgtccagttcaattgatgtattttgtgacattttgctttgttagtcacttacacatgctacaagttttgttggtcagtcacctcacacttttggtgtgaaaaatggcttcaaggcttcctttgtatggataccagttgcattggcaatatgtaaaaatgcgacatgtaatgttttctaatggcaaagtatatattttaaaaaaaaaaaaaaaaaaaaa

SEQ ID NO: 2084 - DNA, 372 bp, Pinus radiata
tttttgttctgcaatcctgttatcacttcgctccatcttccatttttgttttctgacaaccttttaaacatgggaagggcgccttgctgctctaacggtgacagaaacaaaggagcctggaccaaagaagaggatgacaggcttatccaatatattaaggttcatggagagggttgctggcgctctctccccaatgccgcaggtctgcttcggtgtggcaaaagttgcagactgagatggataaattatctttgccctgatctcaaacgagggtttttctccgaagacgaagatgatcttattctcaaactgcacgccctccttggaaataagtggtctttgatagctggccgtttgccaggacgaacagat

SEQ ID NO: 2085 - DNA, 1285 bp, Pinus radiata
gggctgagagaaaagtattttccttgggctgaagagatcaggctaattatggggcggacaccttgttgtgaaaaaaatattgggctgaagaaggggccatggacacctgaggaggatcaaaagctgatagattacatacaaagccatggccatggtagctggcgtgcccttcctaaacgagcagggctcttgagatgtggaaaaagttgcaggctgagatggaccaactatttaagacctgatataaaacgtggacagttttcatttgaggaagagcagactataattgaactccatgctgttcttggaaacaagtggtctactatagctgggcatctgcctgggaggactgacaatgaaataaaaaattactggaacacccatttgaagaaacgccttcttcagatgggaattgatcctgtgacacacaggccaagaacagacctcttggctttttccaatatccaatcttcaatttttaatacacctggttttggtcatatggcccaatgggagagcgccagacttgaagcagaagctcggctgacgggagagtatttgagacaagccttattcatggcaggcaacggatcagccacagctgatctattgatgaggccgtgcaaatccgaatttggcaatgatcagtttaatttgacaaaaaatatgggcaacccaccatggatacagcagcctggaatggccttagactataagggtgccgtacctcagagtttggagcagtttttacagacaaatgtatgttctgcatcagacattaatgggggtggttgtttgagccatgaaggtggcttcaatattacgaagtttgcatctccatgttcaactctggatggaattcaaatcaaaacagaacctcagagtctgtgtggtcctcaagtagtgaaaaatgatagtcagtttcttcatagtgaaggagatctacgaaaacaagccatgcttgatatgaatgtaggatgtaatgttctcattaacatgaatgctgaatccaaggtttcatttggtcacaatggtattataactgaccaagaatacaataatttgggtcaaatagataataataaccatctttctcatgcagctactacactatggcctgttgaaggccagttgcaggccatagccagtgcctccatgcctggattgatatcttccaccagctgcacttcaaacaacatttacagccagcctggtttaattcctcttctcaattccacaacctcttcaatgggtgatacaaattcttacagagaagcgcagccag

SEQ ID NO: 2086 - DNA, 1218 bp, Pinus radiata
cgcagatcgggactgcaaacagaaccatagttctgcaacattcaatgggacggactccttgttgtctgaaagtgggactcaatcgaggtccctggacacccgaggaggatctttgcctctcaaattacatcgaagctcacggagaaggcgggtggagaacacttccaaagaaagcaggtctgctccgatgcgggaagagttgcagattgcgttggatgaattatctccgacccgatgtgaaacacgggcacatattacccgaggaggaagatttaatactcaggttgcatcgtcttcttggaaacaggtggtctttgatcgctggacgtatgcccggcagaacggataatgaggtcaagaactattggaatacccacctcagcaaaaagcttatcagtcagggtatcgacccgcggacgcacaaaccgttgtcagaatccgaagacatatgttcgagtcccgggaatagcgaagtgagccgcaagtctcaacgggaaaataacgctgaaataccaagaaaagttgccgatggcgcagttgatattcaagataaggaagaggatatcacagaagatcagacatctgctcaattgcctgagaatcagcttcttgaaacaagcaattctcaatgcccgtctgtcgctactgatttcgtgcctcaggctccctcgataccttccacggcttattcatttcaacagagcacaacttcaagtgttcccggaggcgtgtcggattcagttgatgttaatcataataagggaagtaagcaagttccttttcctctctcaaatactgcatgttttaatagttcggcacaaggggtagctggtgactatctcgaccaatatttgatgaagaatcttgttactaacagcaatgatctgataacatccactgtgagattaagctccgctttacaaactgcaccttttgtgggacaattcgattcaaatcatgtttttatgtcaggcaatgcatcgctcaatgaaaaacatcagatgcctcagaactcacaagctttggaaatggatccccaccattctttcatagcgcatccttctgaggagggcacctatgataaattgaaccatacaaggtgtgcagcttctgatcaggtcacatcattcaattatccatatcttatttctcataccgttacgggctcagcccttggggattttaatccggatatctttcctccttttgtggaatctt

SEQ ID NO: 2087 - DNA, 473 bp, Pinus radiata
gaccttttgcatcttcattattcttccgcctgtgaaaagatggggagatctccgtgctgtgagaaggctcatactaacaaaggggcctggactaaacaagaagacgaccgccttatcgctcacattcgagcccacggcgaagggggctggcgttcgcttcccaaggccgcagggctgctgagatgcggcaagagctgcagactgcgatggataaactacctgcgtcccgatctgaagcgtggaagcttcaccgaagaagaagacgagctcatcatcaaactccactccttcgttggcaacaagtggtctttaattgcagggagattgcccggacggacggacaacgagataaagaactactggaacacacacatcaaaagaaaattgctgagcaagggactcgacccccaaacccatcgtccactcggccagccaaacaatacccccgtcactcggcctgttctcgagcacga

SEQ ID NO: 2088 - DNA, 1150 bp, Pinus radiata
aaacttgctcacggattccgacccttccggctaaagctgctgcatttctgtgtgtattgaagatggggagatctccctgctgtgaaaaagctcatacaaacaaaggggcgtggaccaaagaagaggacgatcgcctcatcgcccacattcgaactcacggcgaaggttgctggcgctcgcttcccaaggccgcagggctgatgcgctgcgggaagagctgcaggctccgatggataaactacctgcgtcctgatctgaagcgtggaaacttctcagaagaagaagacgaactcgtcatcaaactccactccctactcggcaacaagtggtctcttattgcaggcagattgcccgggcggacggacaacgagataaagaactactggaatactcacatcaagagaaaattgctaaacaggggactcgacccccagtcccatcgccccctcggccagccgcacaacagcaacacgacctgcccctctctgcccgccctcgagcacgaaattcttgtgttccagaggccaagaacgccggagatagcagatttctttcaatacgagcgctctgaaagctcgccgatggaaccggccacttctaaagacgcggaagagcatcccgacctcaatcttgatttgtgtatcagcttgccagttcattcgccccccgccacgagcagagcttcgagcgtcgatggaaccgtggattcaaaacctaattcggtttcttgtcacatggggttgcaagtaaattatggtgtgcaatgtgagaacagatattgtgaagagagtgcttccggtgtctcgagtttttacacgctcgtcttatagaagatttgagctttatggtttgcttattaacaccactaagcattcatctgatgaataggcagagtgaaactatatgtttgctcattgtggcagcccggagtttgcagttaatagacagggacgcagctggacagcagttacccaaattattgtttaaagagtgtagatagctcacctatgaacataggaatcgctgtttcaccatggcgctctgtaatatttaaagcgattcatatggaagcttgagcgcgaagtctccagtgccgtatcatcaactaatgtaattgaactgcaattggtcacaaaaaaaaaaaaaaaaa

SEQ ID NO: 2089 - DNA, 723 bp, Pinus radiata
gtttgtcttccccttcattcgcaattgcttgcttggtgtgctgagaggggaggaggacgaggaggaggaaacagagcaacaagcagcccgacagacacacatctcaacaggtggatctttctcgcccgccattctatcaggtgtattattgtgcaacatatagctgaaatatggtttgggggatcttgtagtaggagcatacgatcaattttaggaaccaaggctcattttaactatgggtacaggagagatggggacaccagcgaaaacaactaaggcatccacaccacaggaacagcctccaacaagcactgccatgctttatcctgactgggctgcagcattccaggcttattataactctggaaccacaccaccacctcctcctgcgtactttcattcaagcgttgcatctagtccacagcctcatccatatatgtggggggggcagcctctaatgcctccatatggaactcttcctcccccatatgcggcaatgtatcatcatggcagcatgtatgctcatccatccatgcctccgggtgcacatccatttgctccttatgtgatgacatcgtcgttaagtacaactgaaggtgcacctgtaggcacaacttctggtgcagatgcagaaggaaagccatctgaaccaaaggaccaaactctattgaagaggtccaaaggaagcttaggcagtcttaatatgcttactggcaagattac

SEQ ID NO: 2090 - DNA, 768 bp, Pinus radiata
gtttgactgaaggtttagagttcgattcccacaggtaacagaggccacgaaggtttcaagttcgattcccacaggtcacagaggccacgaaggtttcaagttcgattcccacagttcacagagccaacgaaggtttcaagttcgattccactaggtccaggaggagcaaagaagatcgttgggctcaatggggtgcaaccagtcgaaagtcgagagcgaggaagaggtggtgaagtcaaaggagaggaaacaatttatgaaggagtcagtggcggcccggaatgctttcgccgccgctcattcggcgtccataacgtcgctcaagaacattggggccgcgttgaacgactacgggcagggcgagtcaaaggaatccctgagccaggggcatctccccgtcccccacatatatggcgatccactgcctcccgcgcctcccctgcctccgctactccctcctccgcgcccagatgagcaccccgctcgccccctggagcgctctgccagtgcaccggccatcgccttacagcaacaggcggaggaagacagaaaccctgaagcaaatgctggtgcttccattccagaaggagaagaagacgaagtagaggaggaggaggacgagcatctggtggaggtgtctcactcggttacttcttttaatccacctccgcgtccgcctccttcatccagcgaacccccaccgcctccgctgcctccgctgacgaatcagtgggacttctttgacgacaacagctacttcgagcggca

SEQ ID NO: 2091 - DNA, 479 bp, Pinus radiata; identical to SEQ ID NO: 350

SEQ ID NO: 2092 - DNA, 557 bp, Pinus radiata
gaaagaaggaaagaatggggcgagggcgcgtcgagctgaagcggatcgagaataagattaaccgtcaggtcacgttttcgaaacgccggaatggtctgctgaaaaaggcgtatgaactttcagtgttatgtgatgcagaggtagcactgataatattctcaagcagaggaaaactctatgagttcggaagcgccgggatgctcaagactctggagcgatatcaaaaatgttcatacgtattgcaagacgcgactgtatcggaccgggaggcgcagaattggcatcaagaggttggcaaattaaaagccagagttgaacttttacaacgatcacaaaggcacttattaggtgaagacctgggccccttgagtattaaggagctgcaacaactggaacgtcaacttgaggttgcactgacacatgttaggtcaagaaagactcaagtcatgttggaaatgatggatgaactacgcagaaaggagcgaattttacaagaagtaaacaaatctctgcgcaagaagttgcaggaggccgagggacaggcattcaatgccatg

SEQ ID NO: 2093 - DNA, 356 bp, Pinus radiata
agtattgaaattcccctgttttgatctgatagctatggatctgatggagtcttttgaggcaaaggggaagggagagaagaggagaacggtgaggggaaaaacccagttgaagaggattgagaacgggaccagcaggcaggttactttttgtaagcgcaggaacggtctgctgaagaaagcttacgagctctcggtgctttgtgatgccgaagtggcacttattgttttctctccaagagggaagcgctatgagttcgctaatcccagcatgcagaaaatgttggcacggtacgaaaatttttcagaaggaagtaaagcaacgagtacagcaaaagagcaagatgtccagggtttaa

SEQ ID NO: 2094 - DNA, 404 bp, Pinus radiata
gggcaaggggaaagacacagatgagaaagatcgagagcgcgaccagcaggcaggttacgttttctaagcgcagaaatggattgatgaagaaagcttacgagctgtcggtgctctgcgatgcccaactgggactgattgttttctcccccagagggaaggtctatgaattctccagtacctgcatgcagaaaatgttggcacgatacgaaaaatgttcagaaggaagtgacacgagtacatcaaaagagcaagatgtccagtgtttaaaacgagaaagtgcgaatatggaagaaaggattgaaattcttgaatccatgcaaagaaagatgttgggcgaggagctggcatcatgtgcattgaaggatttgaatcagttggagagccaggttgaacgaggtttgaga

SEQ ID NO: 2095 - DNA, 584 bp, Pinus radiata; identical to SEQ ID NO: 340

SEQ ID NO: 2096 - DNA, 453 bp, Pinus radiata
ctcttgtctgttctcgaaatcggccaaaatgggaaagaagagggtggagctgaaacgcattcaaaaccctagcagtcgacatgctactttctctaaacgcaagaatggattgctaaaaaaggcgttcgagctttctgtcctctgtgatgctgaagtcgctctcatcattttctctgaaactggcaagatttacgaatttgcgagcaataacgatatggcagcaattctgggaaaataccgagtacacgaagaaggcactgaaacgtccagtccaacatcgcttcaaaacgtaaagtatcatgaatcagggcttgagaaattgcaagagaagttgaccgctttgcaaaagaaggaaaagaacttgattggtgaagacttggaggtattaacaatgaaagaactgcaacggcttgaaaaacagttacaaattggcataaaaaggttagtgataga

SEQ ID NO: 2097 - DNA, 509 bp, Pinus radiata
gcaaccggagctttaagactagaatatatatgtagccctcgggctctgacgaatactgaaactagagatacccacctcttatctggtgtgtaaggcacgcaaaatgggaaagaagaaggtggaggtgaaactcattcaaaaccctaccagtcgccaaggatgtttctacaaccgcaagtgcggtttgcttaaaaaagcgtttgagctttctgttctctgtgatgctgaagttgcccttataatcttctcccaaaccggcaagatttacgagtttgcaagccatgacgacgtcaacgcaattctcgcaaaataccggatacaaacgggaacaacaacaaacgcgatgccttcctcgcttcaaaacaccgagccggagacgttgcatgaggagacaaatatgttgggaaaaaggaaaaaagtggagaagttgcatgagaagatcaatatgttggaaaaaagaggaaaaaacatggttggtgaaaatttggagtcattaacggtcaatgaat

SEQ ID NO: 2098 - DNA, 430 bp, Pinus radiata
gtttgttgcggttctccgttccgcgggtctgattgattaattaaagagcaagagtgacgaaaggagtctggagaatggcaagaggaaagacccagatgaagaagattgagaacgtgaccagcagacaggtcacgttttctaagcgaagaaatgggttgctgaagaaggctttcgagctctcggtgctgtgcgatgcagaagtgggacttattgtattctccccaagtgggaagctctatgaattttcgcgtccctgtatgggaaaattgttggagaagtatgaaaagaattcacgagaaagtggtataaataatgcggctaaagagaaagatactcagcattcaaaacgcgaaattgcaaatatggaagagaaaattaggatcctcgaatcaacagaaagaaagatgttggggcaaaatctagcatcatg

SEQ ID NO: 2099 - DNA, 513 bp, Pinus radiata; identical to SEQ ID NO: 380

SEQ ID NO: 2100 - DNA, 526 bp, Pinus radiata
ggattcttgtatttttgtgtgttgctgctgcaacagttcttaaataccaagacattgatgagagcttgagtaatatttctgcaaaaacccaagtaaaccctgaagctagtccaaactagtggaaggaacctcggctattctgtaagttcactcagattttgagaaactcttgggattttgctcaaaatggggcgtggtaaaatagagatcaagaagatcgagaacagcgtgcacaggcaggtgaccttctgcaagcgccgaggcggtctgatgaagaaagcctacgagctttcagtgctgtgcgatgcagatgtagcgctcattgttttctcgagccgaggaaagttgtacgagctgggcaccagcaacaacaacaacaacagtatgaggtcaatattggaaagatatcaaaagtgttcacagacggcaaaacatatgaacttttcgaataatacttcagacgagaaaatgaagcaagaaataaatttacttaaacaacaaattggatcagctaaacttactaaca

SEQ ID NO: 2101 - DNA, 295 bp, Pinus radiata
cctcttggaaggcaaatccttgtactgttccatcctcacgaattggaggttttggaggtggccaggtcatcctcccattagcccatactgtggaacatgaagagtttttggaggttatcaagttggagaatcatggcctgacacaggaagaagctttgctatcgagggatatgtttctgttgcagctttgtagtgggctcgatgaaaatgcagttggggcctgtgctgaacttgtctttgctccaattgatgcatccttagctgacagttctcctttgctcccttctggtttcag

SEQ ID NO: 2102 - DNA, 296 bp, Pinus radiata
ggagaatcatggcctgacacaggaagaagctttgctatcgagggatatgtttctgttgcaggtatcgtatcgacgtgtttctattgcttagcagagaaacttgaagtgtaaaattttaatttttactaattcatttgaattgatgatcttgccattttgattggacagctttgtagtgggctcgatgaaaatgcagttggggcctgtgctgaacttgtctttgctccaattgatgcatccttagctgacagttctcctttgctcccttctggtttcagagtcattcctttagactc

SEQ ID NO: 2103 - DNA, 475 bp, Pinus radiata
gaagtgtggatgttcttactgctttctcaactggaaatggaggaacaattgagcttttatacatgcagatgtatgcgccaactactttagcttctgcccgagatttctggactcttagatacacttctgtattggaagatggtagtcttgtggtttgcgagagatccttgagtggaactcagggaggtcccagcatgcccgcggtgcagcagtttgttagagcagaaatgcaacccagtggatatttgattcggccatgcgaaggtggaggttctctaattcatattgttgaccatatggatttggagccatggagtgttcctgaagtgctacgtccactgtatgaatcatccactgtacttgcccaaaaggttacaatgtcggccttacgccatttgcgtcaaatagcacaagaggcatcttctgatgtggtccttggctggggaagacaacccgctgcattacggacatttag

SEQ ID NO: 2104 - DNA, 1612 bp, Eucalyptus grandis
cccatctcccttcaaaaaacgacgccggcgacgacgacgaccccccaccaccaccaccaccatcgacgactcggcacagcacgcgaaccagtcgcggaaagttcgagaaggaattcgacgctcgggaatcggccgggagaagaggaggaagacgacgaatcggagccttatggtgtccgtgaacccgaacccggcgcaagggttttacttcttcgatcccgcgaacacgaggatccacggtgtcaacgccggctcggcggccgagggcggcggcgccgcgccgccgtacgcggaggacccgagcaagaaggtgcggaagccgtacaccatcaccaagtccagggagagctggaccgagcaggagcacgacaagttcctggaggcgcttcacctgtttgatcgtgattggaagaagattgaagcttttgttggatcaaaaacagttattcagattcgtagccatgcacaaaagtactttctaaaggttcagaagaatgggacaagtgaacatgtaccaccaccacggccaaaaaggaaagctgcccatccatacccacagaaagcacctaaagctccagttgtttcccaagtcaatgggccatttcaagtttcatctgcttttttggaacccgggcatattgtcagacctgatggatcagcattgcttgggaattcccgtacaagtgtagccttgtcttcatggagtcataactctgtacccgcaatgagtgcatcacaggggacaaaagatgtaggaatttctggcccaccagttccaagtaattgttgcaacagcagtagtaatgacagtacaccgaggtcctggccaaatgctcaagcaattgaacctttggatcaacagaaacatcttagagttatgccagatttcgcgcaagtatataggttcattggcagcgtttttgacccggatgctggtggtcatctacagagattgaagcagatggaccctataaatttggaaacggtagtgctcttgatgaaaaatctcagcgcaaatttgacaagccccgaattcgagaaatatcagcacggcttgtttgcttcatatgagggtggtcctgagaagtccaaatctggcggttccttcaagttgctccccgaaaaatctggaagcctaattctgtctgcgtaacttgtgactttaacaaactcgacctcttcgagtcgggcatcgtcggggaaaactgcactgtctttgaagatcaagattagtagtggagaataaagatgccaaggatcgccaagctgtggggatcgcaaaactggtccgtaactgaggtctgggcttgtggtttttgtaggtctgtaaatatcctgtgaaatgggaacacggcagtttgtgcgaacaatgctgagagacatcatcggaagtttaggctttgtataggttcttatcggactttgtatatggctgcgagatacagagatgtcgtgcgacctagaataaagcttaggcgtcgggtctgttgtgtttatgtatatgtgcgcgtgtaagatcgaagaagaggaagtagcgaggaacgtttgatcaggttgtggtttttggtagactatattgcattggctgctttctctcaaaaaaaaaaaaaaa

SEQ ID NO: 2105 - DNA, 1576 bp, Pinus radiata
gaccttttgcatcttcattattcttccgcctgtgaaaagatggggagatctccgtgctgtgagaaggctcatactaacaaaggggcctggactaaacaagaagacgaccgccttatcgctcacattcgagcccacggcgaagggggctggcgttcgcttcccaaggccgcagggctgctgagatgcggcaagagctgcagactgcgatggataaactacctgcgtcccgatctgaagcgtggaagcttcaccgaagaagaagacgagctcatcatcaaactccactccttcgttggcaacaagtggtctttaattgcagggagattgcccggacggacggacaacgagataaagaactactggaacacacacatcaaaagaaaattgctgagcaagggactcgacccccaaacccatcgtccactcggccagccaaacaatacccccgtcactcggcctgttctcgagcacgaaattccggcattccagaaccctgcaacgccggagatagcagacttgttacagcaccaccgattggaaagctcgcctatcaaaccggcagcttcggatgcggaagagcatcccgacctcaatctgaatttgtgtatcagtttgccgtctaattcggccccggccgtaaacagagtatcgagcgtcgatacaacagtagattcaaattctaattctggcgacgggctgtgctggcagtttctctgacggaggtcgtttcaataagagggtgtgcattatcgcagcacgaccacgcttatgaccagtgccaaaggcacaaggactcgtggtggaaagatgtttatagtgcaaagatctccgacttgcttatcgtggaattgaaataatgtgttggagggcgcagagacggtgggaaaaaggttttgtgtgttgcaggtctggagatatggtggggaagtgtatggataataggtatttctataatctgcaattctggtgcaattattcacaacagttagcatttatcaaggaaaaatatacttcgttttgtgttctcagtcgtaggagatataccagtaccagtacattatctgcttgcagggtaagttgaagttcattacattgcaatgccggtgccttatcgccctcatggccgtatttttaaagacaaatcccacgctgcttcagcctgcaacaagatatctttactctcattacactgatacataccactggtcaaaacttcccatcactgtcataggctggaacagagaaactgaagcctgttcaaaattttcaatacttttagatctggtaaagaagccaatgtgagaactgcaaatttcattggggcaaaactcaggtgtactgtcaaagcatgaaagtccagaatttgatggtgggatattcaacatacggcagaggtacccccaatgatgtagaaagtattgggctgggtgcctattaccacttgcagtggtgtaggaaaaagtgtagttctattgcaggagtgtaataaatgaggtagatatttttctccccgattgatgttcaatatagactcagcgacgttttatgtgtgttgaaaaaaaaaaaaaaaaaaaaa

SEQ ID NO: 2106 - DNA, 210 bp, Pinus radiata
ctatgctattacagaatgtgcctccagcactacttgtccgcttcttgcgggaacatcgctcagagtgggctgattgtaacattgatgcttattcttcagctaccatgaaagcaaatgcttacaatgttccaggttcactgggaggcattacagggagtcaagttatccttccactggcacatactgtggaacatgaagagttcttggaag

SEQ ID NO: 2107 - protein, 27 aa, Pinus radiata
MKHHVVHNCCSKKAVKRGFWSPEEDLK

SEQ ID NO: 2108 - protein, 126 aa, Eucalyptus grandis
GISRNFVKTRTPTQVASHAQKYFLRRTNQNRRRRRSSLFDITTDSYFGVSSSTMEEGHHQAHQVPSFPLSLPPAVSPGTGEKLLESLRLRKEGCQSKPTPSKPIRPVPILPIPPSSKMAALDLNKA

SEQ ID NO: 2109 - protein, 130 aa, Eucalyptus grandis
MPGFTRARKMSMSGEEEGDLRRGPWTREEDNLLIHSITCHGEGRWNMLAKSAGLKRTGKSCRLRWLNYLRPDIKRGNLTPQEQLMILELHHKWGNRWSKIAQYLPGRTDNEIKNYWRTRVQKQARQLNIE

SEQ ID NO: 2110 - protein, 146 aa, Eucalyptus grandis
CCDKVGLKKGPWTPEEDQKLLAYIEENGHGSWRALPSKAGLQRCGKSCRLRWTNYLRPDIKRGKFSLQEEQTIIQLHALLGNRWSAIATHLPKRTDNEIKNYWNTHLKKRLAKMGIDPVTHKPKNDALVSSDGQSKSAAKLSHLAQ

SEQ ID NO: 2111 - protein, 99 aa, Eucalyptus grandis
RTLPKNAGLRRCGKSCRLRWTNYLRPDIKRGRFTFEEEETIIQLHGVLGNKWSAIAAQLPGRTDNEIKNYWNTHIKKRLLKMGIDPVTHSPRLDLLDLS

SEQ ID NO: 2112 - protein, 59 aa, Eucalyptus grandis
MGRGRLQLKRIENKINRQVTFSKRRAGLLKKAHEISVLCDAEVALIIFSAKGKLFEYST

SEQ ID NO: 2113 - protein, 79 aa, Eucalyptus grandis
VKHDVETLSSKVKMAEETVKRVTGLNPMLHVMSDMSSVGVPPFDGSPSDTSADAAVPVRDPKHQFYQTNSSNPASSADD

SEQ ID NO: 2114 - protein, 104 aa, Eucalyptus grandis
QVAQLRVENSTLLKRLSDISQKYNVAAVDNRVLEADVETLRAEVKMAEETVKRVTGLNPMLHVMSDMSSVGVPPFDGSPSDTSADAAVPVRDDPKHQFYQTNSM

SEQ ID NO: 2115 - protein, 71 aa, Eucalyptus grandis
MGRHSCCYKQKLRKGLWSPEEDEKLLRYITQYGHGCWSSVPKLAGLQRCGKSCRLRWINYLRPDLKRGTFS

SEQ ID NO: 2116 - protein, 55 aa, Eucalyptus grandis
ELQHLEQQLSGALSSVKEKKEQWLLEQLERSRLQEQRAMLENETLRRQVDELRGF

SEQ ID NO: 2117 - protein, 62 aa, Eucalyptus grandis; identical to SEQ ID NO: 618

SEQ ID NO: 2118 - protein, 49 aa, Eucalyptus grandis
LFPPQSEGFFNPMDGNLSLQIGYNPTCLDEMNASVSSQNVAGFIPGWML

SEQ ID NO: 2119 - protein, 195 aa, Eucalyptus grandis
SGSQVSIIMISSTGKLHEYISPSTSTKKMYDQYQQALEVDLWSSHYEKMQENLRKLKEVNKKLQLEVRRRFGEGLNGMSLSELCGLEQDMDNAVSLIRERKYKTLGNQIDTARKKKKNAEEINKSLLQDWTNLIKHLREDDPHFGMVDNGRDYEAVIGYTDAAAAARLYTLRLQPDQPNLTSGGGSEITTYPLLE

SEQ ID NO: 2120 - protein, 92 aa, Eucalyptus grandis
MAFKSPGGITWLKHLLVKNFYLGEHLKCRNGLIKKAYELSVLCDIDIALIMFSPSDRVSHFSGKRRIEDVLTRFINLTDQERTLLDVQDRRT

SEQ ID NO: 2121 - protein, 41 aa, Eucalyptus grandis; identical to SEQ ID NO: 617

SEQ ID NO: 2122 - protein, 96 aa, Eucalyptus grandis; identical to SEQ ID NO: 655

SEQ ID NO: 2123 - protein, 76 aa, Eucalyptus grandis
FLFRRKQGAVEELKMVQEVRKGPWTEQEDFQLVCFVGLFGDRRWDFIAKVSGLKVAGENNRYVRFKAWGFFGRSYF

SEQ ID NO: 2124 - protein, 55 aa, Eucalyptus grandis
MGRSPCCEKAHTNKGAWTKEEDQRLIDYIRLHGEGCWRSLPKSAGLLRCGKSCRL

SEQ ID NO: 2125 - protein, 123 aa, Eucalyptus grandis; identical to SEQ ID NO: 657

SEQ ID NO: 2126 - protein, 105 aa, Eucalyptus grandis
MARFPRVDKSNSKKTVKKGAWSAEEDQKLVAYIKRYGIWNWTHMAEPAGLARTGKSCRLRWMNYLRPNIKHGNITQEEEEIIINLHRVLGNRWASIASRLSGRTD

SEQ ID NO: 2127 - protein, 115 aa, Eucalyptus grandis; identical to SEQ ID NO: 660

SEQ ID NO: 2128 - protein, 155 aa, Eucalyptus grandis
MGRKCSRCGNIGHNSRTCTTFMGAASACGLKLFGVQLDLSSSSPPSSSASSGSAHPYSLVIKKSLSMDRLSSSSASSSSPSSSLSSPRVLADEHCNKTSLGYLSDGLAARSQEKRKGVPWTEEEHRTFLMGLEKMGKGDWRGISRNYVTTRTPTQ

SEQ ID NO: 2129 - protein, 145 aa, Eucalyptus grandis
RGWRQIEEHVGTKTAVQIRSHAQKFFSKVARGVSGSSEGVIKPIEIPPPRPKRKPMHPYPRKSVDSKEVKLSYQQERSPSPISSVADENTGSPTSVLSAHGSDMLGSASLHQQNRCSSPTSCTTDVPSIGLAVIEKQPEIFKEED

SEQ ID NO: 2130 - protein, 156 aa, Eucalyptus grandis
FGHEFTSSPASSSSLSSSRISIGENSDKASLGYLSDGLLGRSQEKKKGVPWTEEEHRTFLVGLEKLGKGDWRGISRSYVTTRTPAQVASHAQKYFLRQVSFNKKKRRSSLFDMVDVKTAAGDRLGSLTAKPSESVPNCKMGTLMSHLQVHDARTTQ

SEQ ID NO: 2131 - protein, 49 aa, Eucalyptus grandis
MVQEVRKGPWTEQEDFQLVCFVGLFGDRRWDFIAKVSGLKVAGENNRIE

SEQ ID NO: 2132 - protein, 151 aa, Eucalyptus grandis; identical to SEQ ID NO: 651

SEQ ID NO: 2133 - protein, 133 aa, Eucalyptus grandis
MGSRTRVGGGGDDGRVVNGMPSFVPQLPTSNSMGSEGNSIRSSRITDFGTLEQSLGYRIEDAVDLSRNPVFNQMKSSAQALGADVQFGSLNKSLSSSDRNLSVNIVGSQTLSMHRESQSNLVSIPGAHRENWG

SEQ ID NO: 2134 - protein, 150 aa, Eucalyptus grandis
MPPPRAATPDVAGDESSGADAGAGEIMLFGVRVVVDSMRKCVSLNNLSQYQHPQDANPPNASGGSGGNKEEAAKGYASADDAAHNPGGGRERKRGVPWTEEEHRLFLLGLQKVGKGDWRAISRNFVKTRTPTQVASHAQKYFLRRSNLNR

SEQ ID NO: 2135 - protein, 125 aa, Eucalyptus grandis
ENVASGSTERPRIRHQHSQSMDGSTSIKPEMLMSGSEDASAADAKKAMSAAKLAELALIDPKRAKRIWANRQSAARSKERKMRYIAELERKVQTLQTEATTLSAQLTLLQRDTNGLTAENSELKL

SEQ ID NO: 2136 - protein, 72 aa, Eucalyptus grandis
MADSEHSSSDDTYVDSREETSEESKLDFSEDEETLVIRMYNLVGERWSLIAGRIPGRTAEEIEKYWNSRYST

SEQ ID NO: 2137 - protein, 135 aa, Eucalyptus grandis; identical to SEQ ID NO: 665

SEQ ID NO: 2138 - protein, 123 aa, Eucalyptus grandis
DTEDSKKKERHIVTWSQEEDDILREQIGIHGTENWSIIASKFKDKTTRQCRRRWYTYLNSDFKKGGWSPEEDVLLCEAQKIFGNRWTEIAKVVSGRTDNAVKNRFTTLCKKRARYEALAKENT

SEQ ID NO: 2139 - protein, 126 aa, Eucalyptus grandis
MGRQPCCDKLGVKKGPWTAEEDRKLVNFILTHGQCCWRAVPKLAGLRRCGKSCRLRWTNYLRPDLKRGLLNEAEESLVIDLHATLGNRWSKIAARLPGRTDNEIKNHWNTHIKKKLIRMGIDPVTH

SEQ ID NO: 2140 - protein, 108 aa, Eucalyptus grandis
PGSRSSNRRVERKKGNPWTEEEHRRFLIGLQKLGKGDWRGIARDFVTTRTPTQVASHAQKYYIRQSNAGRRKRRSSLFDMAPDMVCLLYDVASAHSLHSVQISGSCMF

SEQ ID NO: 2141 - protein, 109 aa, Eucalyptus grandis
MRKPCCDKQDTNKGAWSKQEDQKLIDYIRKHGEGCWRTLPKAAGLLRCGKSCRLRWINYLRPDLKRGNFAEDEEDLIIKLHALLGNRWSLIAGRLPGRTDNEVKNYWNS

SEQ ID NO: 2142 - protein, 65 aa, Eucalyptus grandis
SPEEDEKLFNYITRFGVGCWSSVPKLAGLQRCGKSCRLRWINYLRPDLKRGMFSQEEEDLIVSLH

SEQ ID NO: 2143 - protein, 121 aa, Pinus radiata
AKSYLGSLTETIQSLNAELERTRSELVEAKKREEEIISKEAERVEKNKREVENLELNLLQTTAEAGRAKLELETAYEEVQSARLETAQLRAALEATEGKFEAMLSETRLEAEHVKGAIEKY

SEQ ID NO: 2144 - protein, 71 aa, Pinus radiata
EILVTQIEQLQRKERMFSEENNFLRKRIVDPHSVLTTPASGSGSLQRSEVETQLVMRPPSSNADFLFNSSH

SEQ ID NO: 2145 - protein, 110 aa, Pinus radiata; identical to SEQ ID NO: 946

SEQ ID NO: 2146 - protein, 50 aa, Pinus radiata
LRGANGCTIPSIGLTSIERVEVQTQLVMRPPHATEMDDNFMDVDNVPLSG

SEQ ID NO: 2147 - protein, 168 aa, Pinus radiata
EDGSLVICERSLSAAQGMPMVSQSQSFVHGELLSSGYLIRPCEGRGALVIMVDHRNLEASSVPEALRPLYESSTFFAQKMTVEASYHLQGKVQPEMISLSKKLQQPCNVRSYSQRLCRGFNEAVNTLPDDGWMSLSKDGLGDVTICESFVKLPEPNASQIAYVNSMGT

SEQ ID NO: 2148 - protein, 120 aa, Pinus radiata
ENESLRARLRHMNGDDINSLKLPELFHLEQQLETAATQVRRRKDQVLDNEKIKRRNKMRRKEDENIILHEMLDQHHGQMEEDNAQINFLFCQPLNRSDTTFPASLLRLQPNQPNLQDIGY

SEQ ID NO: 2149 - protein, 165 aa, Pinus radiata
SPQVEHRPFSPHEDATIIQAHARHGNKWATIARLLPGRTDNAIKNHWNSTLRRRYHGEKDQSNGLAVNLESAAEDKETMTPMTPVTATATATATAMPVALVFPTAADNVRKRSNSSCSANDNPGDAEVESCRLKRLNFSESPSSSENINNNNNNEEAVSGHCNSA

SEQ ID NO: 2150 - protein, 68 aa, Pinus radiata; identical to SEQ ID NO: 990

SEQ ID NO: 2151 - protein, 152 aa, Pinus radiata
QAGLQRCGKSCRLRWINYLRPDLKRGTFSPQEENLIVELHSVLGNRWSQIATHLPGRTDNEIKNLWNSCIKKKLRQRGIDPNTHRPLSEVNAEAGDSKNDNSNKEVETQAAMDESHVSAGNEFKHLNAIPRADTANPKFFHVPVEDNTLIAS

SEQ ID NO: 2152 - protein, 89 aa, Pinus radiata
MRCTRWQGLPFSSKPKVKKGLWSPEEDEKLINYMMKNGLLGCSWSYVAKQIGLQRCGKSCRLRWTNYLRPGLKRGAISPEEEQLIIHLQ

SEQ ID NO: 2153 - protein, 94 aa, Pinus radiata
MGRAPCCDKANVKKGPWSPEEDTKLKAFIEQHGTGGNWIALPQKAGLKRCGKSCRLRWLNYLRPDIRHGGFSEDEDNIICSLYASIGSMVSIIA

SEQ ID NO: 2154 - protein, 217 aa, Pinus radiata; identical to SEQ ID NO: 952

SEQ ID NO: 2155 - protein, 113 aa, Pinus radiata
LGWGRQPAALRTFSQRLCKGFNEAVNGFTDDGWSLMGNDGMEDVTILVNSSPSKLFGQQFASSDGLPALGGGILCAKASMLLQNVPPALLVRFLREHRSEWADSNIDAYSAAS

SEQ ID NO: 2156 - protein, 107 aa, Pinus radiata
MGRSPCCEKAHTNKGAWTKEEDDRLIAHIRTHGEGCWRSLPKAAGLMRCGKSCRLRWINYLRPDLKRGNFSEEEDELIIKLHSLLGNKWSLIAGRLPGRTDNEIKNY

SEQ ID NO: 2157 - protein, 124 aa, Pinus radiata
LWLRFSGMDRSNSATGEEDVLSRCRERKRFMKLAIENRYKLATAHVAYMDSLRRMGTGLRLFAEGETMSESSYSTSPIGTSELAVVLPEKSVSPSPFPSSSPSLSQPQSPRSERAESRSPLDSF

SEQ ID NO: 2158 - protein, 110 aa, Pinus radiata
DGLVQNSRERKKGVPWTEEEHKMFLLGLHKLGKGDWRGISRNFVTSRTPTQVASHAQKYFLRQSNLNKRKRRSSLFDISTDSMEDCYQGIPELSPVMHDLSLGQNSSLTS

SEQ ID NO: 2159 - protein, 175 aa, Pinus radiata
SSPVSKPKLRKGLWSPEEDDKLINYMMKNGQGCWSDVAKQAGLQRCGKSCRLRWINYLRPDLKRGAFSPQEEQLIIHLHSILGNRWSQIAARLPGRTDNEIKNFWNSCIKKKLKHLSASTNNSKSISAPNRTSTMNSSITPFSESSAEPLEVMATRYQPSNAFNHEVPTAENQVL

SEQ ID NO: 2160 - protein, 78 aa, Pinus radiata
MGRAPCCEKVGLKKGPWTPEEDQKLLAYIQEHGHGSWRALPQKAGLLRCGKSCRLRWTNYLRPDIKRGKFNPQEEQTI

SEQ ID NO: 2161 - protein, 159 aa, Pinus radiata
RTPRCDQMGLKKGPWTPEEDQILISYINKHGHGNWRALPKQAGLMRCGKSCRLRWTNYLRPDIKRGNFSLKEEQTIIHLHQILGNRWSAIASHLPGRTDNEIKNVWNTHLKKRLLQIGVDPVTHAPRGYNVSNCYTAVNIRDHHGEQADHQLQSHVCVS

SEQ ID NO: 2162 - protein, 49 aa, Pinus radiata
TPEEDRILISYIKRNGHGKWLALPKQAGLSRCGKSCRLRWTNYLRPNIK

SEQ ID NO: 2163 - protein, 78 aa, Pinus radiata
MGTGEEATPTKPAAKPSSSSQETPTTPVYPDWAAAFQAYYGPGATPPPPAFFASTVGSAPTPHPYMWGGQPLMPPYGT

SEQ ID NO: 2164 - protein, 113 aa, Pinus radiata; identical to SEQ ID NO: 935

SEQ ID NO: 2165 - protein, 107 aa, Pinus radiata
TKAAIKRLQSQIMVAFQAVDTTSAAILKLREDELYPQLVELSKGLMQMWRAMYECHQVQNHIVQQVRHLGNLASAEATSSYHQQATIQLEAQVTAWYDSFCRMITSQ

SEQ ID NO: 2166 - protein, 38 aa, Pinus radiata
MGAPKQKWTSEEEGALRAGVEKYGAGKWQTILKDPEFA

SEQ ID NO: 2167 - protein, 158 aa, Pinus radiata
SGHMDGGSGEDQDAADQDHDHDHDHDHEQQQTRRKRYHRHTARQIQEMEALFKECPHPDDKQRQRLSIELGLKPRQVKFWFQNRRTQMKAQQDRSDNAILRAENENLRNENVALREAIKNGACPNCGGSTSLGEMPGFDEHHFRIENTRLKEELDRVS

SEQ ID NO: 2168 - protein, 122 aa, Pinus radiata
MGCTQGQRQGEWEGKGVPSNSSRRSLRKGLWSPDEDIELTTYIMRKGLMGCWNYIAKQAGLQRCGKSCRLRWINYLRPGLKRCAISPQEERLIIQLQSSLGNRWSQIAAHLPGRTDNEVKNY

SEQ ID NO: 2169 - protein, 101 aa, Pinus radiata
MGRSPCCEKAHTNKGAWTQQEDTRLVAHIRAHGQGGWSSLPKAAGLLRCGKSCRQRWINYLHPDLKRSNFSEEEDELIVRLHSLLGNKWSLIAGRLPGRTD

SEQ ID NO: 2170 - protein, 133 aa, Pinus radiata
RLLPGRTDNAIKNHWNSTLRRRYHGEKDQSNGLAVNLESAAEDKETMTPMTPVTATATATATAMPVALVFPTAADNVRKRSNSSCSANDNPGDAEVESCRLKRLNFSESPSSSENINNNNNNEEAVSGHCNSA

SEQ ID NO: 2171 - protein, 120 aa, Pinus radiata
MRCKTGQAQGVLEVEGTHPAPSKPKLRKGLWSPVEDNQLTNYILRRGLVGCWNYVAKQAGLQRTGKSCRLRWINYLRPGLKRHPISRQEEQLIIELQSILGNRWSQIAAQLPGRTDIEIK

SEQ ID NO: 2172 - protein, 155 aa, Pinus radiata
QQLESSRIKLKQIEQELERVKQQGISINGHLGDHNGSGAAAFDMEYGRWVEEQNRQARELRASLQAHLTDSELCVLVDNAIAHYDELFRMKGAASKLDVFHLMSGMWKTPTERCFMWMGGFRPSELLKILTPQIEPLTEQQSFAVSSLKLSSQQA

SEQ ID NO: 2173 - protein, 63 aa, Pinus radiata; identical to SEQ ID NO: 959

SEQ ID NO: 2174 - protein, 76 aa, Pinus radiata
RARKTEILVTEIEQLQRKEWILSEENAFLGKKFVHPHSVSKTPGSESGSIQNSEVETQLVMRPPCTNAHFLINSSH

SEQ ID NO: 2175 - protein, 161 aa, Eucalyptus grandis
RESANCASRVADRRENRRRRDMGNQKLKWTKEEEEALLAGIAKHGAGKWKNILKDPEFAPALVNRSNIDLKDKWRNLSVGTSGQGSRDKQRLSKVKSLMAAPQSSTVPLNPQAHAASTDVALVNSSNSFQDGKNYSLWVSVLLFLFSNGNLFYFYPLLSFL

SEQ ID NO: 2176 - protein, 31 aa, Eucalyptus grandis
TRQSARALLAIHDYFSRLRALSSLWLARPRE

SEQ ID NO: 2177 - protein, 191 aa, Eucalyptus grandis
MASRKEVDRIKGPWSPEEDEALRLLVQKHGPRNWSLISKSIPGRSGKSCRLRWCNQLSPQVEHRAFTPEEDDIIVRAHARFGNKWATIARLLSGRTDNAIKNHWNSTLKRKCSPPLSPLAEEGNNRAFDAAAGYDGDLSPRERPAKRSASAGPCLSPGSPSGSGMSDSSVHFVYRPVAKTGPVVPPTVEAT

SEQ ID NO: 2178 - protein, 113 aa, Eucalyptus grandis
QVAQLRVENSTLLKRLSDISQKYNVAAVDNRVLKADVETLRAKVKMAEETVKRVTGLNPMLHVMSDMSSVGVPPFDGSPSDTSADAAVPVRDDPKHQFYQTNSSNPASSADDM

SEQ ID NO: 2179 - protein, 314 aa, Eucalyptus grandis
MKRLGSSDSLGALMSICPPSEELQHSPRNGNPIYHSRDLQSMLELGLDEEGCVEDQSAGGGGHVGGEKKRRLSIDQVKALEKNFEVENKLEPERKVKLAQELGLQPRQVAVWFQNRRARWKTKQLERDYGVLKSSYEALKLSYDALKHDNEALHKEIKELKSKLREEDDNPESNLSVKEEVIIPGHDVSDKIRAADDGDDDTKRSPPPPITAPPRELSFNNGGLKDGSSDSDSSAIVNEENAATSSSSPNPAVQSHGGFLKFMGSSSSSASPPPSPPASFGGCFSFQFQRAYQPQPQPPHHHHHHSPYVKMEEH

SEQ ID NO: 2180 - protein, 94 aa, Eucalyptus grandis
ERYKSACSDSSHPQSVSDVNTQFYQQEASKLRRQIREIQVSDRHLLGEGISDLSFKDLKNLESKLEKSISRVRSKKNEMLFAEIEYMQKRGLVQ

SEQ ID NO: 2181 - protein, 83 aa, Eucalyptus grandis
ENKINRQVTFAKRRNGLLKKAYELSVLCDAEVALIIFSTRGKLYEFCSSPSMLKTLDRYQKCSYGSVEVNKPSKELENAYREY

SEQ ID NO: 2182 - protein, 108 aa, Eucalyptus grandis
MGRGKIEIQKIENDTNRQVTYSKRRNGIFKKAHELTVLCDARVSILMLSGNKKLHEYISPTTTTKRMIDDYQKALGIDLWTTHYDRMQEELRKLKEVNNNFRKEIRQI

SEQ ID NO: 2183 - protein, 40 aa, Eucalyptus grandis
RNLMGEDLGTLNSKELEQLERQLEASLKHIRSTKTQCMLD

SEQ ID NO: 2184 - protein, 161 aa, Eucalyptus grandis
MVFPTQATPEESPQRKMGRGKIEIKRIENTTNRQVTFCKRRNGLLKKAYELSVLCEAEVALIVFSSRGRLYEYANDSVKATIERYKKACSDSSSSGSVSEANVQFYQQESAKLQQQINNMQNNNRQLVGDSIAGMNMKDMKTTEQKLEKAIAKIRAKKNAI

SEQ ID NO: 2185 - protein, 92 aa, Eucalyptus grandis
QHKEQMLVEANRELRKKLEESNTRIPLRLGWEAEDHNNISYSRLPMQSQGLIFQPLGGNPTLQIGYNPAGSNELNVSAADQHPNGFIPGWML

SEQ ID NO: 2186 - protein, 113 aa, Eucalyptus grandis
GSKELESLERQLDGSLKQIRSRRTQYMLDKLTDLQHREQLLHEANRTLNQRLMEGYQVNALQLNQHAEEVGGYGHPPPPPLPPQPLAQPHSEAFFNPLECEPTLQMGYQPDPV

SEQ ID NO: 2187 - protein, 309 aa, Eucalyptus grandis
MTRRCSHCCNKGHNSRTCPVRGGGGDGGGAAAAPSSSSPSTSSSGAAAAAAASASGGGVKLFGVRLTDGSIMKKSASVGCLSAAHYHSSSSAAASPNPGSSPIDGSDGYLSDDPAPGSRSSNRRVERKKGNPWTEEEHRRFLIGLQKLGKGDWRGIARDFVTTRTPTQVASHAQKYYIRQSNAGRRKRRSSLFDMAPDMATADQPSHPEETFLPPLVRLNDDTNSTTSTSMGLDLERTPMETSHPETSEGGGDVAMESIDQVPLVPCYFPYYLPLPFPMWPPNMAPPEDGRVVETSHHRVLKPIPVIPK

SEQ ID NO: 2188 - protein, 123 aa, Eucalyptus grandis
WDTSSSPPTLLESVDNFILSPARTGKAESECLSPRNSGLLDALVHESKTMSSAKNNSPEKSTNSSALTPGDISSSTLDICKSEWEEYGDPISPPGHSATSVFNGCTPLSTSGSSLDEQPYPDT

SEQ ID NO: 2189 - protein, 136 aa, Eucalyptus grandis
HIRRKLLNRGIDPATHRPLNEPAQDATTISFAAAPSKQEPRDDAIAAALGYKNENNPTTTAATVQEKCPDLNLELRISPPCQQQHQPDASMGMVEGNHCFACSLGLQNSKECSCRRGASGGSSAHGGYDFLGLKTS

SEQ ID NO: 2190 - protein, 109 aa, Eucalyptus grandis
MEFPSEFSEASSQKRIGGRGKIEIKRIENTTNRQVTFCKRRNGLLKKAYELSVLCDAEVALIVFSSRGRLYEYANNSVRGTIERYKKASSDSSTSHSPFPEVEHSSFIQ

SEQ ID NO: 2191 - protein, 116 aa, Eucalyptus grandis
MGRGRVELKRIENKINRQVTFSKRRNGLLKKAYELSVLCDVEVALLIFSSRGKLYEFGSAGPSGINKTLERYQRDNFTPQDNVAEHETQQNWFQEISKLKAKYELFNKLQKHLLGK

SEQ ID NO: 2192 - protein, 98 aa, Eucalyptus grandis
MARGKVQMKRIENPVHRQVTFCKRRAGLLKKAKELSVLCDADIGLFIFSPHGKLYELATKGTMKGLIERYMKTTQSQAALTEEATPSQPLDAKEEINI

SEQ ID NO: 2193 - protein, 198 aa, Eucalyptus grandis
MGRGKVELKRIENKINRQVTFAKRRNGLLKKAYELSVLCDAEVALIIFSNRGKLYEFCSSSSMMKTIEKYQKCSYGSLETNCSINEMQNSYQDYLKLKTRVEVLQRSQRNLLGEELGPLNSKELEQLEHQLENSLKQIRSAKTQFMFDQLAHLQHKEQMLVEANRELRKKLEESNTRIPLRLGWEAEDHNNISYSRLP

SEQ ID NO: 2194 - protein, 153 aa, Eucalyptus grandis
MRKPCCDKRDTNKGAWSKQEDQKLIDYIQKHGEGSWRTLPQAAGLLRCGKSCRLRWINYLRPDLKRGNFAEDEEDLIIKLHALLGNRWSLIAGRLPGRTDNEVKNYWNSHLRRKLLKMGIDPNNHRLNQNLPRSQTRMPRQHFLIQYEDHMTL

SEQ ID NO: 2195 - protein, 104 aa, Eucalyptus grandis
EALQQSLVDTLSSTTLSPTGSGNVAEYMGQMAIAMGKLATLENFVHQADLLRQQTLQQMHRILTTRQAARALLVINDYISRLRALSSLWLARPRTENICSAKLF

SEQ ID NO: 2196 - protein, 25 aa, Eucalyptus grandis
DPLMKPWQIPCPIQPIIASADLFEC

SEQ ID NO: 2197 - protein, 87 aa, Eucalyptus grandis
MGRRKIEIQPITHERNRSVTFLKRKNGLFKKAYELGVLCSVDVAVIIFEDRPGHSPKLYQYSSRGIQDIVQRHLHHDGETDNRGPGD

SEQ ID NO: 2198 - protein, 107 aa, Eucalyptus grandis
RDRTFLVGLEKLGKGDWRGISRSYVTTRTPAQVASHAQKYFLRQVSFNKKKRRSSLFDMVKNQCSYKLLPSYRLSSISLMGFDKFLLYKVDVKTAAGDRLGSLTAKP

SEQ ID NO: 2199 - protein, 107 aa, Eucalyptus grandis
MTLEEFLVRAGVVREDTQMMARPGDNGVHEEMSQFTSNGLASSAAAGNDFIFSSKPAGSSLDFIGTRPTQLQQQPQPQPLEPPAPLFPKPETVSFATSVHLPNTASY

SEQ ID NO: 2200 - protein, 150 aa, Eucalyptus grandis
ANAPLRIAMNSNASSNPQSMATSTTSATTPAAGGDGGKKVRKPYTITKSRESWTEEEHDKFLEALQLFDRDWKKIEDFVGSKTVIQIRSHAQKYFLKVQKNGAVAHVPPPRPKRKAAHPYPQKASKNVLVPLQASMAQPSSTNPAFTITP

SEQ ID NO: 2201 - protein, 171 aa, Eucalyptus grandis
MGRSPCCESEHMNKGAWSKEEDERLIAYIKRHGEGCWRSLPKAAGLLRCGKSCRLRWINYLRPDLKRGNFSDEEDELIITLHSLLGNKWSLIAARLPGRTDNEIKNYWNTHIKRKLHARGIDPQTHRPLRLHQHCWCWCCCHFTLSVLTLTTAATRPRLTRRLVKNYHHHQ

SEQ ID NO: 2202 - protein, 98 aa, Eucalyptus grandis
MNSPLAQLVNPRRMHTYEPFDQFPMWGDTFKADKVKNLEASSSVIVHAVDDGLDKKFEYVSHESAENSSSRSDQEANRPDKVQRRLAQNREAARKSRL

SEQ ID NO: 2203 - protein, 111 aa, Eucalyptus grandis
MNSPLAQLVNPRRMHTYEPFDQFPMWGDTFKADKVKNLEASSSVIVHAVDDGLDKKFEYVSHESAENSSSRSDQEANRPDKVQRRLAQNREAARKSRLRKKKYVQQLESSR

SEQ ID NO: 2204 - protein, 162 aa, Eucalyptus grandis
MASSSSVASARKDADRIKGPWSPEEDEALQRLVQSYGPRNWSLISKSIPGRSGKSCRLRWCNQLSPQVEHRPFTPEEDEAIVRAHARFGNKWATIARLLNGRTDNAVKNHWNSTLKRKCSSTCSAGGDDADALAEQQPLKRSASLGTPTGGNNAVSDLFFSP

SEQ ID NO: 2205 - protein, 92 aa, Eucalyptus grandis
MAKEKIKIKKIDNLTARQVTFSKRRRGLIKKAEELSVLCDADVSLIVFSATGKLYDFSSSRQMKGEDLEGLNVEELDQLEKKLEAGLSLVIK

SEQ ID NO: 2206 - protein, 148 aa, Eucalyptus grandis
MRKPDASGKNSSNSNANKLRKGLWSPEEDDKLMNYMLNNGQGCWSDVARNAGLQRCGKSCRLRWINYLRPDLKRGAFSPQEEELIIHLHSILGNRWSQIAARLPGRTDNEIKNFWNSTIKKRSRTRHHLLVDTRQTRAILLASDVKDV

SEQ ID NO: 2207 - protein, 73 aa, Eucalyptus grandis
APEIAPPLAAPRGGHHRRAHSEVNFRIPEDLDLGPDPFENGPSGSFEDFGSEDDLLSTYMDIEKFGSSSTRAG

SEQ ID NO: 2208 - protein, 147 aa, Eucalyptus grandis
SENVSGGAIERPRATGKLAAPVNSPSMSSSLDLKNSCMDANANPVSILQPGVVPPEAWLQVMSLCGRLLKIFPWKASTSVLSAVSSSCSLQYHRLCFSKFALCKNERELKRERRKQSNRESARRSRLRKQAETEELGKKVDSLSAEN

SEQ ID NO: 2209 - protein, 115 aa, Eucalyptus grandis
FFLYIISLFLVRENSERSREGTSSNGDGKSEVQGKVAGEVDAASENVSGGAIERPRATGKLAAPVNSPSMASSLDLKNSCMDANANPVSILQPGVVPPEAWLQNERELKRERREQ

SEQ ID NO: 2210 - protein, 192 aa, Eucalyptus grandis
MGRQPCCDKSGVKKGPWTAEEDKKLINFILTNGHCCWRAVPKLAGLRRCGKSCRLRWTNYLRPDLKRGLLSEAEEQLVIDLHARLGNRWSKIAARLPGRTDNEIKNHWNTHIKKKLLKMGIDPVTHEPLNKPQKTPSEHDPEASLSSSQADPTSESPANTHQPNNAHADEVQLVLVLPVGLVRRELLLRQGR

SEQ ID NO: 2211 - protein, 89 aa, Pinus radiata
LSRNMDDVFVQRCNRNFTARDRLISKERRNFGWVCGVTEEEEELIIRMYKLVGNRWSLIAGRLPGRKAEEIERYWKMRSINAAPLKPNT

SEQ ID NO: 2212 - protein, 237 aa, Pinus radiata
MVKELLMMCSNCGHSGHSSRACPDRGSVKLFGVRLIATDDGMACMRKSLSMGNLGHYRSLYNVNHCSGTSECGSADQDGYLSDGFVHSSSNARERKKGVPWSEEEHRMFLYGLEKLGKGDWRGISRNFVTTRTPTQVASHAQKYFLRQSNLNKRKRRSSLFDMCPHDSHVTSSFRREDSLGNLYEFSPKHSALGVSPNFELYSFGVSPTLSLGRSLQPVEAVLEEKAAHYHPVNSEE

SEQ ID NO: 2213 - protein, 55 aa, Pinus radiata
WLQLCSGIDEHAAGFCSQLVFAPIDASFADDAPLAPSGFRVIPLESGSECFSSKT

SEQ ID NO: 2214 - protein, 119 aa, Pinus radiata
GVLKFPCFDLITMNLMESFEAKGKGEKRRTVRGKTQLKRIENGTSRQVTFCKRRNGLLKKAYELSVLCDAEVALIVFSPRGKLYEFANPSMQKMLERYEKCSEGSNPTSTAKEQDVQCL

SEQ ID NO: 2215 - protein, 146 aa, Pinus radiata
PKQDQKLVTYIQEHGHGSWRALPQKAGLLRCGKSCRLRWANYLRPDIKRGKFTVQEEQTIIQLHALLGNRWSAIATHLPKRTDNEIKNYWNTHLKKRLLQMGIDPVTHKPKSESIMVPGVQSSNGSSNLSHMAQWESARLEAESKA

SEQ ID NO: 2216 - protein, 106 aa, Pinus radiata
GIFIGGSCVGGDQSHSMSGNGALAFDMEYARWLDEHHRQINELRSAVNSHVGDNELRGLVEGVMGHYDEIFRLKTVASKADVFHLVSGMWKTPAERCFMWMGGFRP

SEQ ID NO: 2217 - protein, 114 aa, Pinus radiata; identical to SEQ ID NO: 937

SEQ ID NO: 2218 - protein, 126 aa, Pinus radiata
WNLIEEKIEGRSGKSCRLRWFNQLDPRINRRPFTEEDEEKLLAAHRLYGNKWAMIARLFPGRTDNAVKNHWHVIMARRYREQSSAFGRRKLPQVHRREKRACTDDETRMGSSSCNMWVDKYSSLKS

SEQ ID NO: 2219 - protein, 123 aa, Pinus radiata
LIAYIRANGEGSWRSLPKAAGLPRCGKSCRLRWINYLRPDLKRGSFTEEEDELIIKLHSVVGNKWSLIAGRLPGRTDNEIKNYWNTHIKRKLLIKGIDPQSHRPLGQPYSSNNMPVSRLFLTS

SEQ ID NO: 2220 - protein, 176 aa, Pinus radiata; identical to SEQ ID NO: 926

SEQ ID NO: 2221 - protein, 119 aa, Pinus radiata
LYQCQALFENGAVEKLSRTYNDLYDDLKEEILSWLPVECVCRFRSVSKQWNNLLSSHNFIKKVWRKKPANMNPWLVLHPVNSSYCLAYCFFTRTWKTTSSISIENANNYGENGILGISC

SEQ ID NO: 2222 - protein, 124 aa, Pinus radiata
DKKLINFLTTHGQCCWRTVPELAGISRCGKSCRLRWTNYLRPDLKRGVFSESEEKLILDLHSRVGNRWSKIASFLPGRTDNELKNYWNTHIKKKLKRMGLDPGDAQAISETLPQPAPVAENNDV

SEQ ID NO: 2223 - protein, 175 aa, Pinus radiata
MKGKSPGHDEPDRIKGPWSPEEDAALQHFVQKYGPRNWSLISKAIPGRSGKSCRLRWCNQLSPQVEHRPFTPEEDATIVRAHAQHGNKWATIARMLSGRTDNAIKNHWNSTLRRRCQGGGALVIDDEISSGADGFRKRNLSEDADASRKFKKLSLGTTTTTTTTEPSTSSASDRS

SEQ ID NO: 2224 - protein, 103 aa, Pinus radiata
MSSRSCSLCGLNGHNSRTCVGSGVMLFGVRLTDGPMRKSASMNNLSNLSQYEHSDPAEVAAEGFDGYVSDDLVHSSSNARERKRGVPWTEEEHRMFLVGLQRV

SEQ ID NO: 2225 - protein, 96 aa, Pinus radiata
MSSRSCSLCGLNGHNSRTCVGSGVMLFGVRLTDGPMRKSASMNNLSNLSQYEHSDPAEVAAEGFDGYVSDDLVHSSSNARERKRGVPWTEEEHRMF

SEQ ID NO: 2226 - protein, 131 aa, Pinus radiata
RGRVQLRRIENKISRQVTFSKRRNGLMKKAAELSILCDAEVALIVFSNKDKLYEFASSSMTKILERYRKRSNLIQDIGKDPQNSDIELTRLKEEVDRLQRSRRHLLGEDLHQLGATDLQHLEQQLEEALQK

SEQ ID NO: 2227 - protein, 49 aa, Pinus radiata
MPSIMEKQNSGEDSDSKGQLDNGKYVRYTNEQVETLERAYNECSKPSTR

SEQ ID NO: 2228 - protein, 128 aa, Pinus radiata; identical to SEQ ID NO: 980

SEQ ID NO: 2229 - protein, 181 aa, Pinus radiata
EDLDDCIHPPEKKRRLTADQVQFLERSFEIENKLEPERKIQLAKELGLQPRQVAVWFQNRRARWKTKQLERDYDILKSRYENLRVDYDSLLKEKDKLRAEVTFLTDKLHDSDHEALTKDSESADKKVYPQPASHSDCVGEPERSTAAKDTPPGCKHEDLLSSGTDSSGVLDEDSPHHVDCG

SEQ ID NO: 2230 - protein, 107 aa, Pinus radiata
MGRSPCCEKAHTNKGAWTKEEDDRLIAHIRTHGEGCWRSLPKAAGLMRCGKSCRLRWINYLRPDLKRGNFSEEEDELVIKLHSLLGNKWSLIAGRLPGRTDNEIKNY

SEQ ID NO: 2231 - protein, 125 aa, Pinus radiata
KKGVPWTEEEHRQFLMGLRKYGKGDWRSISRNFVVSRTPTQVASHAQKYYIRLGSDNKNKRRSSIHDITTVHGTDRMPSPLLHVSNRQTNSPSTQAEMNHSPCLDISISDFTRTSNKLFGTSNRW

SEQ ID NO: 2232 - protein, 150 aa, Pinus radiata
MTRKCSHCGNNGHNSRTCPNRGGVKLFGVRLTDGPIRKSASMGNLMMMSNPSSPADPSEPASAAAAAAAAAASGYLSDGLVEASTSSNSRERKKGVPWTEEEHRMFLLGLQKLGKGDWRGIARNFVITRTPTQVASHAQKYFIRQSNMTR

SEQ ID NO: 2233 - protein, 102 aa, Pinus radiata
MKMSLPSNVLTLSADSNSNSNSISSSGDELAAKVRKPYTITKQRERWSEDEHLKFLEALKMYGRAWRRIEEHIGTKTAVQIRSHAQKFFSKLVRGSSNKGVS

SEQ ID NO: 2234 - protein, 85 aa, Pinus radiata
GIDMNRGPATNESEYSSVFQADALRTIDTGSVVVKRERERTFELEAERDRTCDVSSRTSDEEEIGSTRKKLRLSKEQSALLEESF

SEQ ID NO: 2235 - protein, 115 aa, Pinus radiata
NLESLTLKELQQLEKQLGRAIKKIYNKKMKIISQCCKSLSEKVRSLEEENSELLTKLIPRADSSTSGAALFVDTSMPKSHSATEAWRQLLQRVLVTAAKMATTPPARHSNSRPNH

SEQ ID NO: 2236 - protein, 88 aa, Pinus radiata
GKATSGSANEAMSQSGDSGSDGSSEGSEEYNTQTESQVARKRSFDQMIVDGANAQSTNIQSYNSQAGEPYVTSGGHAMGNPISQAVAA

SEQ ID NO: 2237 - protein, 66 aa, Pinus radiata
QLKWKERILTEENLFLRKKCGDEHVDCSAFRTPPAQLRSIQNIDVETQLVIRPPTVQQHPDVDSPR

SEQ ID NO: 2238 - protein, 176 aa, Pinus radiata
MGRTPCCLKVGLNRGPWTPEEDLCLSNYIEAHGEGGWRTLPKKAGLLRCGKSCRLRWMNYLRPDVKHGHILPEEEDLILRLHRLLGNRWSLIAGRMPGRTDNEVKNYWNTHLSKKLISQGIDPRTHKPLSESEDICSSPGNSEVSRKSQRENNAEIPRKVADGAVDIQDKEEDITE

SEQ ID NO: 2239 - protein, 105 aa, Pinus radiata; identical to SEQ ID NO: 924

SEQ ID NO: 2240 - protein, 78 aa, Pinus radiata
MSNGRLCEDLDRIKGPWSPEEDASLQRLVQKYGPRNWTLISKGIPGRSGKSCRLRWCNQLSPQVEHRPFTPSEDAAIL

SEQ ID NO: 2241 - protein, 67 aa, Pinus radiata
MGRALGRTEIKRIENEVSRNVSFRKRRRGLLKKAAELSILCDATVGVVVFSPAGKLSEYASTSEQMD

SEQ ID NO: 2242 - protein, 131 aa, Pinus radiata
IRNPTNRHSSFYKRKGGLLKKAFELAVLCDAEVALIIFSETGRIYEFASHDDVTTVLAKYRIQTKTAGNAMPSSLQKTEFDQLQVRMLQEKIDNLEKTKKHMVGDNLESLTWKELQQVEKKLSKATKIIVA

SEQ ID NO: 2243 - protein, 29 aa, Pinus radiata
QPVAPESIVPPHQPPHNQTPNQYMQGWWV

SEQ ID NO: 2244 - protein, 107 aa, Pinus radiata; identical to SEQ ID NO: 2156

SEQ ID NO: 2245 - protein, 168 aa, Pinus radiata
TAEEDRKLVNFITLHGHGCWREVPKLAGLLRCGKSCRLRWTNYLRPDLKRGLLSESEEKLIIDLHAAIGNRWSRIAAQLPGRTDNEIKNYWNTRIKKKLRQMGIDPVTHKPLTQMQMQSTPAQTLLLQENDTEQQQQEQHNEPDPDQNQSSNGTVETLVSRAREPHDH

SEQ ID NO: 2246 - protein, 164 aa, Pinus radiata
SDGTTTMSTYERKASLREFYAVIYPSLLQLEGGITEMEDNKQKLICKERYKKRVDEERRHLSELDLEREKECGICMETQTKVVLPNCSHAMCLNCYREWHARSESCPFCRDSLKRVNSTDLWIFTSNEEVVDMETLGRENLKRLFNYIDKLPLIVPESLFYVYD

SEQ ID NO: 2247 - protein, 414 aa, Pinus radiata
MGRHSCCYKQKLRKGLWSPEEDEKLLRHISQYGHGCWSSVPKQAGLQRCGKSCRLRWINYLRPDLKRGAFSQDEEDLIIELHAALGNKWSQIAANLPGRTDNEIKNLWNSCLKKKLRQRGIDPVSHRPLSEVENSDDKDATSGQTQDKVSRGSVELLSQLNPQFSSSTTARSSKNSNLMAPTLSKDTVADGFVSNHQENSMMNSCISDFVDNFSLQQLNYSSSDSRFSNLCFTQTGRAHGNTIFSDFNSNVISAISPPSSNSLFPTASMGFNFKPSNAVPSANSTSSASTGTADFHNSGSYFGNSLVSWGLLADCGSPDKEGSTSIHPLEVHQPGDFKWAAEYLQNPLFMAAALQNQAQEQSNLYNQIKPETQFPPDHSTTSMWDHLQGHESLDNSLNTCGKDIQRLTALLGHN

SEQ ID NO: 2248 - protein, 205 aa, Pinus radiata
MRYPAPAPASRGKSTSTATPCCSKVGIKRGPWTPEEDEVLASYVRREGEGRWRTLPKRAGLQRCGKSCRLRWMNYLRPSVKRGQIAPDEEDLILRLHRLLGNRWSLIAGRIPGRTDNEIKNYWNTHLSKKLISQGIDPRTHKPLLNHNPSSSLAAHLQDTYNASTFTPKATYPNPTVPVEETGDENDLKVGRQPAGSASKRGRCQ

SEQ ID NO: 2249 - protein, 195 aa, Pinus radiata
MDKKPDDDSGKSQDVEVRKGPWTMEEDLILINYIANHGEGSWNSLAKAAGLKRTGKSCRLRWLNYLRPDVRRGNITTEEQLLIMELHAKWGNRWSKIAKHLPGRTDNEIKNFWRTRIQKHIKQAEAFSGQSSEMSDQASTSHMSSMPEPMETYDSPPSFQGNNNMEPLPVNLSVESNEAYWSMDDLWSMQLLNGD

SEQ ID NO: 2250 - protein, 208 aa, Pinus radiata
MDKKPCYRTQDPQVRKGPWTLEEDLILMDYIANHGEGVWNSLAKAAGLQRTGKSCRLRWLNYLRPDVRRGNITPEEQLLIIHLQSMWGNRWSEIAKHLPGRTDNEIKNYWRTKIQKHIIKQSETEINDLTIPPSSANACTDHRGVSAANTIEIACSPPSDQGGSGETMLSALPPAQEPNDSACWSVEDLWPIQSLISGMGDDAQYYSV

SEQ ID NO: 2251 - protein, 147 aa, Pinus radiata
MNSTTTQFVSSRRMGMYDPIHQIGMWDENFKQNGNPNAPPALIIPMHANLDNQSEDTSHGSQDTAGKYEQETSKPYDKVQRRLAQNREAARKSRLRKKAYVQQLEASRLKLMQLEQEVDRARQQGVYMASGVDSAYPGYGGCLNSGI

SEQ ID NO: 2252 - protein, 43 aa, Pinus radiata; identical to SEQ ID NO: 611

SEQ ID NO: 2253 - protein, 54 aa, Pinus radiata
MGRSPCCEKAHTNKGAWTKQEDDRLIAHIRAHGEGGWRSLPKAAGCLPALCFLN

SEQ ID NO: 2254 - protein, 66 aa, Pinus radiata
MGRAPCCEKVGLKKGPWTPEEDQKLVTYIQEHGHGSWRALPQKAGDYEFIFSSRTCKKFSVFLFFG

SEQ ID NO: 2255 - protein, 67 aa, Pinus radiata
MGRSPCCAKEGLNRGAWTKTEDIILSEYIRIHGDGGWRSLPKKAGLKRCGKSCRLRWLNYLRPDIKR

SEQ ID NO: 2256 - protein, 226 aa, Pinus radiata
MGRAPCCSNDDRNKGAWTKEEDDRLIQYIKVHGEGCWRSLPKAAGLLRCGKSCRLRWINYLRPDLKRGFFSEDEDDLILKLHALLGNNRWSLIAGRLPGRTDNEIKNYWNSHLKRKLISMGIDPLTHRPFQKTSHHHPSPPQNVREAETTPSIGIVQDFFRCPSELSTKSEQISDAASGLAQDEQPHPNLNLNLELSIARSSVHRVAEKEDVVNSQQGESNLSEGK

SEQ ID NO: 2257 - protein, 101 aa, Pinus radiata
MGRAPCCSNGDRNKGAWTKEEDDRLIQYIKVHGEGCWRSLPNAAGLLRCGKSCRLRWINYLCPDLKRGFFSEDEDDLILKLHALLGNKWSLIAGRLPGRTD

SEQ ID NO: 2258 - protein, 412 aa, Pinus radiata
MGRTPCCEKNIGLKKGPWTPEEDQKLIDYIQSHGHGSWRALPKRAGLLRCGKSCRLRWTNYLRPDIKRGQFSFEEEQTIIELHAVLGNKWSTIAGHLPGRTDNEIKNYWNTHLKKRLLQMGIDPVTHRPRTDLLAFSNIQSSIFNTPGFGHMAQWESARLEAEARLTGEYLRQALFMAGNGSATADLLMRPCKSEFGNDQFNLTKNMGNPPWIQQPGMALDYKGAVPQSLEQFLQTNVCSASDINGGGCLSHEGGFNITKFASPCSTLDGIQIKTEPQSLCGPQVVKNDSQFLHSEGDLRKQAMLDMNVGCNVLINMNAESKVSFGHNGIITDQEYNNLGQIDNNNHLSHAATTLWPVEGQLQAIASASMPGLISSTSCTSNNIYSQPGLIPLLNSTTSSMGDTNSYREAQP

SEQ ID NO: 2259 - protein, 391 aa, Pinus radiata
MGRTPCCLKVGLNRGPWTPEEDLCLSNYIEAHGEGGWRTLPKKAGLLRCGKSCRLRWMNYLRPDVKHGHILPEEEDLILRLHRLLGNRWSLIAGRMPGRTDNEVKNYWNTHLSKKLISQGIDPRTHKPLSESEDICSSPGNSEVSRKSQRENNAEIPRKVADGAVDIQDKEEDITEDQTSAQLPENQLLETSNSQCPSVATDFVPQAPSIPSTAYSFQQSTTSSVPGGVSDSVDVNHNKGSKQVPFPLSNTACFNSSAQGVAGDYLDQYLMKNLVTNSNDLITSTVRLSSALQTAPFVGQFDSNHVFMSGNASLNEKHQMPQNSQALEMDPHHSFIAHPSEEGTYDKLNHTRCAASDQVTSFNYPYLISHTVTGSALGDFNPDIFPPFVES

SEQ ID NO: 2260 - protein, 144 aa, Pinus radiata
MGRSPCCEKAHTNKGAWTKQEDDRLIAHIRAHGEGGWRSLPKAAGLLRCGKSCRLRWINYLRPDLKRGSFTEEEDELIIKLHSFVGNKWSLIAGRLPGRTDNEIKNYWNTHIKRKLLSKGLDPQTHRPLGQPNNTPVTRPVLEH

SEQ ID NO: 2261 - protein, 255 aa, Pinus radiata
MGRSPCCEKAHTNKGAWTKEEDDRLIAHIRTHGEGCWRSLPKAAGLMRCGKSCRLRWINYLRPDLKRGNFSEEEDELVIKLHSLLGNKWSLIAGRLPGRTDNEIKNYWNTHIKRKLLNRGLDPQSHRPLGQPHNSNTTCPSLPALEHEILVFQRPRTPEIADFFQYERSESSPMEPATSKDAEEHPDLNLDLCISLPVHSPPATSRASSVDGTVDSKPNSVSCHMGLQVNYGVQCENRYCEESASGVSSFYTLVL

SEQ ID NO: 2262 - protein, 162 aa, Pinus radiata
MGTGEMGTPAKTTKASTPQEQPPTSTAMLYPDWAAAFQAYYNSGTTPPPPPAYFHSSVASSPQPHPYMWGGQPLMPPYGTLPPPYAAMYHHGSMYAHPSMPPGAHPFAPYVMTSSLSTTEGAPVGTTSGADAEGKPSEPKDQTLLKRSKGSLGSLNMLTGKI

SEQ ID NO: 2263 - protein, 193 aa, Pinus radiata
MGCNQSKVESEEEVVKSKERKQFMKESVAARNAFAAAHSASITSLKNIGAALNDYGQGESKESLSQGHLPVPHIYGDPLPPAPPLPPLLPPPRPDEHPARPLERSASAPAIALQQQAEEDRNPEANAGASIPEGEEDEVEEEEDEHLVEVSHSVTSFNPPPRPPPSSSEPPPPPLPPLTNQWDFFDDNSYFER

SEQ ID NO: 2264 - protein, 128 aa, Pinus radiata; identical to SEQ ID NO: 941

SEQ ID NO: 2265 - protein, 181 aa, Pinus radiata
MGRGRVELKRIENKINRQVTFSKRRNGLLKKAYELSVLCDAEVALIIFSSRGKLYEFGSAGMLKTLERYQKCSYVLQDATVSDREAQNWHQEVGKLKARVELLQRSQRHLLGEDLGPLSIKELQQLERQLEVALTHVRSRKTQVMLEMMDELRRKERILQEVNKSLRKKLQEAEGQAFNAM

SEQ ID NO: 2266 - protein, 107 aa, Pinus radiata
MDLMESFEAKGKGEKRRTVRGKTQLKRIENGTSRQVTFCKRRNGLLKKAYELSVLCDAEVALIVFSPRGKRYEFANPSMQKMLARYENFSEGSKATSTAKEQDVQGL

SEQ ID NO: 2267 - protein, 134 aa, Pinus radiata; identical to SEQ ID NO: 945

SEQ ID NO: 2268 - protein, 138 aa, Pinus radiata; identical to SEQ ID NO: 931

SEQ ID NO: 2269 - protein, 141 aa, Pinus radiata
MGKKRVELKRIQNPSSRHATFSKRKNGLLKKAFELSVLCDAEVALIIFSETGKIYEFASNNDMAAILGKYRVHEEGTETSSPTSLQNVKYHESGLEKLQEKLTALQKKEKNLIGEDLEVLTMKELQRLEKQLQIGIKRLVI

SEQ ID NO: 2270 - protein, 135 aa, Pinus radiata
MGKKKVEVKLIQNPTSRQGCFYNRKCGLLKKAFELSVLCDAEVALIIFSQTGKIYEFASHDDVNAILAKYRIQTGTTTNAMPSSLQNTEPETLHEETNMLGKRKKVEKLHEKINMLEKRGKNMVGENLESLTVNE

SEQ ID NO: 2271 - protein, 118 aa, Pinus radiata
MARGKTQMKKIENVTSRQVTFSKRRNGLLKKAFELSVLCDAEVGLIVFSPSGKLYEFSRPCMGKLLEKYEKNSRESGINNAAKEKDTQHSKREIANMEEKIRILESTERKMLGQNLAS

SEQ ID NO: 2272 - protein, 147 aa, Pinus radiata; identical to SEQ ID NO: 971

SEQ ID NO: 2273 - protein, 113 aa, Pinus radiata
MGRGKIEIKKIENSVHRQVTFCKRRGGLMKKAYELSVLCDADVALIVFSSRGKLYELGTSNNNNNSMRSILERYQKCSQTAKHMNFSNNTSDEKMKQEINLLKQQIGSAKLTN

SEQ ID NO: 2274 - protein, 97 aa, Pinus radiata
SWKANPCTVPSSRIGGFGGGQVILPLAHTVEHEEFLEVIKLENHGLTQEEALLSRDMFLLQLCSGLDENAVGACAELVFAPIDASLADSSPLLPSGF

SEQ ID NO: 2275 - protein, 157 aa, Pinus radiata
SVDVLTAFSTGNGGTIELLYMQMYAPTTLASARDFWTLRYTSVLEDGSLVVCERSLSGTQGGPSMPAVQQFVRAEMQPSGYLIRPCEGGGSLIHIVDHMDLEPWSVPEVLRPLYESSTVLAQKVTMSALRHLRQIAQEASSDVVLGWGRQPAALRTF

SEQ ID NO: 2276 - protein, 327 aa, Pinus radiata
MVSVNPNPAQGFYFFDPANTRIHGVNAGSAAEGGGAAPPYAEDPSKKVRKPYTITKSRESWTEQEHDKFLEALHLFDRDWKKIEAFVGSKTVIQIRSHAQKYFLKVQKNGTSEHVPPPRPKRKAAHPYPQKAPKAPVVSQVNGPFQVSSAFLEPGHIVRPDGSALLGNSRTSVALSSWSHNSVPAMSASQGTKDVGISGPPVPSNCCNSSSNDSTPRSWPNAQAIEPLDQQKHLRVMPDFAQVYRFIGSVFDPDAGGHLQRLKQMDPINLETVVLLMKNLSANLTSPEFEKYQHGLFASYEGGPEKSKSGGSFKLLPEKSGSLILSA

SEQ ID NO: 2277 - protein, 225 aa, Pinus radiata
MGRSPCCEKAHTNKGAWTKQEDDRLIAHIRAHGEGGWRSLPKAAGLLRCGKSCRLRWINYLRPDLKRGSFTEEEDELIIKLHSFVGNKWSLIAGRLPGRTDNEIKNYWNTHIKRKLLSKGLDPQTHRPLGQPNNTPVTRPVLEHEIPAFQNPATPEIADLLQHHRLESSPIKPAASDAEEHPDLNLNLCISLPSNSAPAVNRVSSVDTTVDSNSNSGDGLCWQFL

SEQ ID NO: 2278 - protein, 69 aa, Pinus radiata
MLLQNVPPALLVRFLREHRSEWADCNIDAYSSATMKANAYNVPGSLGGITGSQVILPLAHTVEHEEFLE

SEQ ID NO: 2279 - protein, 65 aa, Pinus radiata
MARFPRVDKSNSKKTVKKGAWSAEEDQKLVAYIKRYGIWNWTHMAEPAGLARTGKSCRLRWMNYL

SEQ ID NO: 2280 - protein, 39 aa, Pinus radiata
PNIKHGNITQEEEEIIINLHRVLGNRWASIASRLSGRTD

SEQ ID NO: 2281 - protein, 59 aa, Pinus radiata
RKPCCDKQDTNKGAWSKQEDQKLIDYIRKHGEGCWRTLPKAAGLLRCGKSCRLRWINYL

SEQ ID NO: 2282 - protein, 48 aa, Pinus radiata
PDLKRGNFAEDEEDLIIKLHALLGNRWSLIAGRLPGRTDNEVKNYWNS

SEQ ID NO: 2283 - protein, 19 aa, Pinus radiata
CCSKKAVKRGFWSPEEDLK

SEQ ID NO: 2284 - protein, 45 aa, Pinus radiata
WTREEDNLLIHSITCHGEGRWNMLAKSAGLKRTGKSCRLRWLNYL

SEQ ID NO: 2285 - protein, 57 aa, Pinus radiata
RPDIKRGNLTPQEQLMILELHHKWGNRWSKIAQYLPGRTDNEIKNYWRTRVQKQARQ

SEQ ID NO: 2286 - protein, 57 aa, Pinus radiata
MASRKEVDRIKGPWSPEEDEALRLLVQKHGPRNWSLISKSIPGRSGKSCRLRWCNQL

SEQ ID NO: 2287 - protein, 68 aa, Pinus radiata
SPQVEHRAFTPEEDDIIVRAHARFGNKWATIARLLSGRTDNAIKNHWNSTLKRKCSPPLSPLAEEGNN

SEQ ID NO: 2288 - protein, 61 aa, Pinus radiata
MGRHSCCYKQKLRKGLWSPEEDEKLLRYITQYGHGCWSSVPKLAGLQRCGKSCRLRWINYL

SEQ ID NO: 2289 - protein, 78 aa, Pinus radiata
GSSPIDGSDGYLSDDPAPGSRSSNRRVERKKGNPWTEEEHRRFLIGLQKLGKGDWRGIARDFVTTRTPTQVASHAQKY

SEQ ID NO: 2290 - protein, 53 aa, Pinus radiata
KKGNPWTEEEHRRFLIGLQKLGKGDWRGIARDFVTTRTPTQVASHAQKYYIRQ

SEQ ID NO: 2291 - protein, 59 aa, Pinus radiata
RKPCCDKRDTNKGAWSKQEDQKLIDYIQKHGEGSWRTLPQAAGLLRCGKSCRLRWINYL

SEQ ID NO: 2292 - protein, 65 aa, Pinus radiata
PDLKRGNFAEDEEDLIIKLHALLGNRWSLIAGRLPGRTDNEVKNYWNSHLRRKLLKMGIDPNNHR

SEQ ID NO: 2293 - protein, 54 aa, Pinus radiata
MGRSPCCEKAHTNKGAWTKEEDQRLIDYIRLHGEGCWRSLPKSAGLLRCGKSCR

SEQ ID NO: 2294 - protein, 65 aa, Pinus radiata; identical to SEQ ID NO: 2279

SEQ ID NO: 2295 - protein, 40 aa, Pinus radiata
RPNIKHGNITQEEEEIIINLHRVLGNRWASIASRLSGRTD

SEQ ID NO: 2296 - protein, 41 aa, Pinus radiata
RKGVPWTEEEHRTFLMGLEKMGKGDWRGISRNYVTTRTPTQ

SEQ ID NO: 2297 - protein, 31 aa, Pinus radiata
RKGVPWTEEEHRTFLMGLEKMGKGDWRGISR

SEQ ID NO: 2298 - protein, 44 aa, Pinus radiata
EVRKGPWTEQEDFQLVCFVGLFGDRRWDFIAKVSGLKVAGENNR

SEQ ID NO: 2299 - protein, 61 aa, Pinus radiata
MGRSPCCESEHMNKGAWSKEEDERLIAYIKRHGEGCWRSLPKAAGLLRCGKSCRLRWINYL

SEQ ID NO: 2300 - protein, 67 aa, Pinus radiata
PDLKRGNFSDEEDELIITLHSLLGNKWSLIAARLPGRTDNEIKNYWNTHIKRKLHARGIDPQTHRPL

SEQ ID NO: 2301 - protein, 50 aa, Pinus radiata
KRGVPWTEEEHRLFLLGLQKVGKGDWRAISRNFVKTRTPTQVASHAQKYF

SEQ ID NO: 2302 - protein, 53 aa, Pinus radiata
KRGVPWTEEEHRLFLLGLQKVGKGDWRAISRNFVKTRTPTQVASHAQKYFLRR

SEQ ID NO: 2303 - protein, 64 aa, Pinus radiata
MASSSSVASARKDADRIKGPWSPEEDEALQRLVQSYGPRNWSLISKSIPGRSGKSCRLRWCNQL

SEQ ID NO: 2304 - protein, 98 aa, Pinus radiata
SPQVEHRPFTPEEDEAIVRAHARFGNKWATIARLLNGRTDNAVKNHWNSTLKRKCSSTCSAGGDDADALAEQQPLKRSASLGTPTGGNNAVSDLFFSP

SEQ ID NO: 2305 - protein, 50 aa, Pinus radiata
LRKGLWSPEEDDKLMNYMLNNGQGCWSDVARNAGLQRCGKSCRLRWINYL

SEQ ID NO: 2306 - protein, 60 aa, Pinus radiata
PDLKRGAFSPQEEELIIHLHSILGNRWSQIAARLPGRTDNEIKNFWNSTIKKRSRTRHHL

SEQ ID NO: 2307 - protein, 44 aa, Pinus radiata
KLDFSEDEETLVIRMYNLVGERWSLIAGRIPGRTAEEIEKYWNS

SEQ ID NO: 2308 - protein, 61 aa, Pinus radiata
MGRQPCCDKLGVKKGPWTAEEDRKLVNFILTHGQCCWRAVPKLAGLRRCGKSCRLRWTNYL

SEQ ID NO: 2309 - protein, 64 aa, Pinus radiata
PDLKRGLLNEAEESLVIDLHATLGNRWSKIAARLPGRTDNEIKNHWNTHIKKKLIRMGIDPVTH

SEQ ID NO: 2310 - protein, 61 aa, Pinus radiata
MGRQPCCDKSGVKKGPWTAEEDKKLINFILTNGHCCWRAVPKLAGLRRCGKSCRLRWTNYL

SEQ ID NO: 2311 - protein, 67 aa, Pinus radiata
PDLKRGLLSEAEEQLVIDLHARLGNRWSKIAARLPGRTDNEIKNHWNTHIKKKLLKMGIDPVTHEPL

SEQ ID NO: 2312 - protein, 50 aa, Pinus radiata
KKGVPWSEEEHRMFLYGLEKLGKGDWRGISRNFVTTRTPTQVASHAQKYF

SEQ ID NO: 2313 - protein, 53 aa, Pinus radiata
KKGVPWSEEEHRMFLYGLEKLGKGDWRGISRNFVTTRTPTQVASHAQKYFLRQ

SEQ ID NO: 2314 - protein, 60 aa, Pinus radiata
GKSPGHDEPDRIKGPWSPEEDAALQHFVQKYGPRNWSLISKAIPGRSGKSCRLRWCNQLS

SEQ ID NO: 2315 - protein, 60 aa, Pinus radiata
PQVEHRPFTPEEDATIVRAHAQHGNKWATIARMLSGRTDNAIKNHWNSTLRRRCQGGGAL

SEQ ID NO: 2316 - protein, 20 aa, Pinus radiata
KRGVPWTEEEHRMFLVGLQR

SEQ ID NO: 2317 - protein, 18 aa, Pinus radiata
KRGVPWTEEEHRMFLVGL

SEQ ID NO: 2318 - protein, 10 aa, Pinus radiata
KRGVPWTEEE

SEQ ID NO: 2319 - protein, 14 aa, Pinus radiata
KRGVPWTEEEHRMF

SEQ ID NO: 2320 - protein, 68 aa, Pinus radiata
MRCTRWQGLPFSSKPKVKKGLWSPEEDEKLINYMMKNGLLGCSWSYVAKQIGLQRCGKSCRLRWTNYL

SEQ ID NO: 2321 - protein, 62 aa, Pinus radiata
MGRAPCCDKANVKKGPWSPEEDTKLKAFIEQHGTGGNWIALPQKAGLKRCGKSCRLRWLNYL

SEQ ID NO: 2322 - protein, 60 aa, Pinus radiata
MGRSPCCEKAHTNKGAWTKEEDDRLIAHIRTHGEGCWRSLPKAAGLMRCGKSCRLRWINY

SEQ ID NO: 2323 - protein, 46 aa, Pinus radiata
RPDLKRGNFSEEEDELIIKLHSLLGNKWSLIAGRLPGRTDNEIKNY

SEQ ID NO: 2324 - protein, 61 aa, Pinus radiata
MGRAPCCEKVGLKKGPWTPEEDQKLLAYIQEHGHGSWRALPQKAGLLRCGKSCRLRWTNYL

SEQ ID NO: 2325 - protein, 61 aa, Pinus radiata
MGRSPCCEKAHTNKGAWTKEEDDRLIAHIRTHGEGCWRSLPKAAGLMRCGKSCRLRWINYL

SEQ ID NO: 2326 - protein, 45 aa, Pinus radiata
PDLKRGNFSEEEDELVIKLHSLLGNKWSLIAGRLPGRTDNEIKNY

SEQ ID NO: 2327 - protein, 50 aa, Pinus radiata
KKGVPWTEEEHRMFLLGLQKLGKGDWRGIARNFVITRTPTQVASHAQKYF

SEQ ID NO: 2328 - protein, 53 aa, Pinus radiata
KKGVPWTEEEHRMFLLGLQKLGKGDWRGIARNFVITRTPTQVASHAQKYFIRQ

SEQ ID NO: 2329 - protein, 48 aa, Pinus radiata
QRERWSEDEHLKFLEALKMYGRAWRRIEEHIGTKTAVQIRSHAQKFFS

SEQ ID NO: 2330 - protein, 42 aa, Pinus radiata
QRERWSEDEHLKFLEALKMYGRAWRRIEEHIGTKTAVQIRSH

SEQ ID NO: 2331 - protein, 61 aa, Pinus radiata
MGRTPCCLKVGLNRGPWTPEEDLCLSNYIEAHGEGGWRTLPKKAGLLRCGKSCRLRWMNYL

SEQ ID NO: 2332 - protein, 67 aa, Pinus radiata
PDVKHGHILPEEEDLILRLHRLLGNRWSLIAGRMPGRTDNEVKNYWNTHLSKKLISQGIDPRTHKPL

SEQ ID NO: 2333 - protein, 55 aa, Pinus radiata
CEDLDRIKGPWSPEEDASLQRLVQKYGPRNWTLISKGIPGRSGKSCRLRWCNQLS

SEQ ID NO: 2334 - protein, 56 aa, Pinus radiata
KGPWSPEEDASLQRLVQKYGPRNWTLISKGIPGRSGKSCRLRWCNQLSPQVEHRPF

SEQ ID NO: 2335 - protein, 34 aa, Pinus radiata
MGAPKQKWTSEEEGALRAGVEKYGAGKWQTILKD

SEQ ID NO: 2336 - protein, 51 aa, Pinus radiata
LRKGLWSPDEDIELTTYIMRKGLMGCWNYIAKQAGLQRCGKSCRLRWINYL

SEQ ID NO: 2337 - protein, 45 aa, Pinus radiata
PGLKRCAISPQEERLIIQLQSSLGNRWSQIAAHLPGRTDNEVKNY

SEQ ID NO: 2338 - protein, 62 aa, Pinus radiata
MGRSPCCEKAHTNKGAWTQQEDTRLVAHIRAHGQGGWSSLPKAAGLLRCGKSCRQRWINYLH

SEQ ID NO: 2339 - protein, 39 aa, Pinus radiata
PDLKRSNFSEEEDELIVRLHSLLGNKWSLIAGRLPGRTD

SEQ ID NO: 2340 - protein, 61 aa, Pinus radiata
GTHPAPSKPKLRKGLWSPVEDNQLTNYILRRGLVGCWNYVAKQAGLQRTGKSCRLRWINYL

SEQ ID NO: 2341 - protein, 43 aa, Pinus radiata
PGLKRHPISRQEEQLIIELQSILGNRWSQIAAQLPGRTDIEIK

SEQ ID NO: 2342 - protein, 61 aa, Pinus radiata
MGRHSCCYKQKLRKGLWSPEEDEKLLRHISQYGHGCWSSVPKQAGLQRCGKSCRLRWINYL

SEQ ID NO: 2343 - protein, 67 aa, Pinus radiata
PDLKRGAFSQDEEDLIIELHAALGNKWSQIAANLPGRTDNEIKNLWNSCLKKKLRQRGIDPVSHRPL

SEQ ID NO: 2344 - protein, 58 aa, Pinus radiata
TPCCSKVGIKRGPWTPEEDEVLASYVRREGEGRWRTLPKRAGLQRCGKSCRLRWMNYL

SEQ ID NO: 2345 - protein, 67 aa, Pinus radiata
PSVKRGQIAPDEEDLILRLHRLLGNRWSLIAGRIPGRTDNEIKNYWNTHLSKKLISQGIDPRTHKPL

SEQ ID NO: 2346 - protein, 67 aa, Pinus radiata
MDKKPDDDSGKSQDVEVRKGPWTMEEDLILINYIANHGEGSWNSLAKAAGLKRTGKSCRLRWLNYLR

SEQ ID NO: 2347 - protein, 56 aa, Pinus radiata
PDVRRGNITTEEQLLIMELHAKWGNRWSKIAKHLPGRTDNEIKNFWRTRIQKHIKQ

SEQ ID NO: 2348 - protein, 63 aa, Pinus radiata
MDKKPCYRTQDPQVRKGPWTLEEDLILMDYIANHGEGVWNSLAKAAGLQRTGKSCRLRWLNYL

SEQ ID NO: 2349 - protein, 54 aa, Pinus radiata
PDVRRGNITPEEQLLIIHLQSMWGNRWSEIAKHLPGRTDNEIKNYWRTKIQKHI

SEQ ID NO: 2350 - protein, 47 aa, Pinus radiata
SRESWTEQEHDKFLEALHLFDRDWKKIEAFVGSKTVIQIRSHAQKYF

SEQ ID NO: 2351 - protein, 59 aa, Pinus radiata
SWTEQEHDKFLEALHLFDRDWKKIEAFVGSKTVIQIRSHAQKYFLKVQKNGTSEHVPPP

SEQ ID NO: 2352 - protein, 45 aa, Pinus radiata
MGRSPCCEKAHTNKGAWTKQEDDRLIAHIRAHGEGGWRSLPKAAG

SEQ ID NO: 2353 - protein, 45 aa, Pinus radiata
MGRAPCCEKVGLKKGPWTPEEDQKLVTYIQEHGHGSWRALPQKAG

SEQ ID NO: 2354 - protein, 61 aa, Pinus radiata
MGRSPCCAKEGLNRGAWTKTEDIILSEYIRIHGDGGWRSLPKKAGLKRCGKSCRLRWLNYL

SEQ ID NO: 2355 - protein, 61 aa, Pinus radiata
MGRAPCCSNDDRNKGAWTKEEDDRLIQYIKVHGEGCWRSLPKAAGLLRCGKSCRLRWINYL

SEQ ID NO: 2356 - protein, 68 aa, Pinus radiata
PDLKRGFFSEDEDDLILKLHALLGNNRWSLIAGRLPGRTDNEIKNYWNSHLKRKLISMGIDPLTHRPF

SEQ ID NO: 2357 - protein, 61 aa, Pinus radiata
MGRAPCCSNGDRNKGAWTKEEDDRLIQYIKVHGEGCWRSLPNAAGLLRCGKSCRLRWINYL

SEQ ID NO: 2358 - protein, 39 aa, Pinus radiata
PDLKRGFFSEDEDDLILKLHALLGNKWSLIAGRLPGRTD

SEQ ID NO: 2359 - protein, 62 aa, Pinus radiata
MGRTPCCEKNIGLKKGPWTPEEDQKLIDYIQSHGHGSWRALPKRAGLLRCGKSCRLRWTNYL

SEQ ID NO: 2360 - protein, 66 aa, Pinus radiata
PDIKRGQFSFEEEQTIIELHAVLGNKWSTIAGHLPGRTDNEIKNYWNTHLKKRLLQMGIDPVTHRP

SEQ ID NO: 2361 - protein, 61 aa, Pinus radiata; identical to SEQ ID NO: 2331

SEQ ID NO: 2362 - protein, 67 aa, Pinus radiata; identical to SEQ ID NO: 2332

SEQ ID NO: 2363 - protein, 61 aa, Pinus radiata
MGRSPCCEKAHTNKGAWTKQEDDRLIAHIRAHGEGGWRSLPKAAGLLRCGKSCRLRWINYL

SEQ ID NO: 2364 - protein, 67 aa, Pinus radiata
PDLKRGSFTEEEDELIIKLHSFVGNKWSLIAGRLPGRTDNEIKNYWNTHIKRKLLSKGLDPQTHRPL

SEQ ID NO: 2365 - protein, 61 aa, Pinus radiata; identical to SEQ ID NO: 2363

SEQ ID NO: 2366 - protein, 67 aa, Pinus radiata; identical to SEQ ID NO: 2364

SEQ ID NO: 2367 - protein, 61 aa, Pinus radiata; identical to SEQ ID NO: 2325

SEQ ID NO: 2368 - protein, 67 aa, Pinus radiata
PDLKRGNFSEEEDELVIKLHSLLGNKWSLIAGRLPGRTDNEIKNYWNTHIKRKLLNRGLDPQSHRPL

What is claimed is:

1. An isolated polynucleotide that encodes a polypeptide comprising a sequence selected from the group consisting of SEQ ID NO: 2346 and 2347.

2. A DNA construct comprising a polynucleotide sequence selected from the group consisting of:
    (a) SEQ ID NO: 2076; and
    (b) sequences that are degeneratively equivalent to SEQ ID NO: 2076, wherein the sequence encodes a Myb transcription factor.

3. A DNA construct comprising, in the 5'–3' direction:
    (a) a gene promoter sequence,
    (b) an open reading frame of an isolated polynucleotide comprising a sequence selected from the group consisting of:
        (i) SEQ ID NO: 2076; and
        (ii) sequences that are degeneratively equivalent to SEQ ID NO: 2076, wherein the sequence encodes a Myb transcription factor; and
    (c) a gene termination sequence.

4. The DNA construct of claim 3 wherein the open reading frame is in a sense orientation.

5. The DNA construct of claim 3 wherein the open reading frame is in an antisense orientation.

6. The DNA construct of claim 3 wherein the gene promoter sequence and gene termination sequences are functional in a plant host.

7. The DNA construct of claim 3 further comprising a marker for identification of transformed cells.

8. A DNA construct comprising in the 5'–3' direction:
    (a) a gene promoter sequence,
    (b) an untranslated region of an isolated polynucleotide comprising a sequence selected from the group consisting of:
        (i) SEQ ID NO: 2076; and
        (ii) sequences that are degeneratively equivalent to SEQ ID NO: 2076, wherein the sequence encodes a Myb transcription factor; and
    (c) a gene termination sequence.

9. The DNA construct of claim 8 wherein the untranslated region is in a sense orientation.

10. The DNA construct of claim 8 wherein the untranslated region is in an antisense orientation.

11. The DNA construct of claim 8 wherein the gene promoter sequence and gene termination sequence are functional in a plant host.

12. An isolated polynucleotide comprising SEQ ID NO: 2076.

13. An isolated polynucleotide comprising a sequence that is degeneratively equivalent to SEQ ID NO: 2076 wherein the polynucleotide encodes a Myb transcription factor.

14. An isolated polynucleotide comprising a sequence selected from the group consisting of:
    (a) nucleotide sequences that are 200-mers of SEQ ID NO: 2076;
    (b) nucleotide sequences that are 100-mers of SEQ ID NO: 2076; and
    (c) nucleotide sequences that are 40-mers of SEQ ID NO: 2076.

* * * * *